US012060553B2

(12) United States Patent
Packer et al.

(10) Patent No.: US 12,060,553 B2
(45) Date of Patent: Aug. 13, 2024

(54) EVOLUTION OF BoNT PEPTIDASES

(71) Applicants: President and Fellows of Harvard College, Cambridge, MA (US); Ipsen Biopharm Ltd, Wrexham (GB); The Broad Institute, Inc., Cambridge, MA (US)

(72) Inventors: Michael S. Packer, Cambridge, MA (US); Travis R. Blum, Cambridge, MA (US); David R. Liu, Cambridge, MA (US); Keith A. Foster, Salisbury (GB); Matthew Brian Beard, Leighton Buzzard (GB)

(73) Assignees: President and Fellows of Harvard College, Cambridge, MA (US); Ipsen Biopharm Ltd, Wrexham (GB); The Broad Institute, Inc., Cambridge, MA (US)

( * ) Notice: Subject to any disclaimer, the term of this patent is extended or adjusted under 35 U.S.C. 154(b) by 504 days.

(21) Appl. No.: 16/641,630

(22) PCT Filed: Aug. 27, 2018

(86) PCT No.: PCT/US2018/048134
§ 371 (c)(1),
(2) Date: Feb. 24, 2020

(87) PCT Pub. No.: WO2019/040935
PCT Pub. Date: Feb. 28, 2019

(65) Prior Publication Data
US 2021/0163924 A1    Jun. 3, 2021

Related U.S. Application Data

(60) Provisional application No. 62/550,408, filed on Aug. 25, 2017.

(51) Int. Cl.
*C12N 15/10* (2006.01)
*A61K 38/00* (2006.01)
(Continued)

(52) U.S. Cl.
CPC .......... *C12N 15/1058* (2013.01); *C07K 14/33* (2013.01); *C12N 9/52* (2013.01);
(Continued)

(58) Field of Classification Search
CPC ...... C12N 15/1058; C12N 9/52; C12N 15/70; C12N 2795/14143; C12N 15/63; C07K 14/33; A61K 38/00
See application file for complete search history.

(56) References Cited

U.S. PATENT DOCUMENTS 5,057,432 A    10/1991    Wangersky et al.
5,223,409 A    6/1993    Ladner et al.
(Continued)

FOREIGN PATENT DOCUMENTS

EP    0289479 A2    11/1988
EP    3115457 A1    1/2017
(Continued)

OTHER PUBLICATIONS

Sikorra et al. "Identification and Characterization of Botulinum Neurotoxin A Substrate Binding Pockets and Their Re-Engineering for Human SNAP-23", Jan. 29, 2016, Journal of Molecular Biology, vol. 428 No. 2, p. 372-384. (Year: 2016).*
(Continued)

*Primary Examiner* — Gary B Nickol
*Assistant Examiner* — Amelia Nicole Dickens
(74) *Attorney, Agent, or Firm* — Wolf, Greenfield & Sacks, P.C.

(57) ABSTRACT

The disclosure provides amino acid sequence variants of Botulinum neurotoxin (BoNT) proteases that cleave
(Continued)

(VAMP1, VAMP2, VAMP7, VAMP8, SNAP25, SNAP23, PTEN, etc.) and methods of evolving the same. In some embodiments, proteases described by the disclosure are useful for cleaving proteins found in a cell, that is in an intracellular environment. In some embodiments, proteases described by the disclosure are useful for treating diseases associated with increased or aberrant VAMP7, VAMP8, SNAP23 or PTEN expression or activity, for example, cancer and neurological disorders. Some aspects of this disclosure provide methods for generating BoNT protease variants by continuous directed evolution.

20 Claims, 43 Drawing Sheets

Specification includes a Sequence Listing.

(51) Int. Cl.
    *C07K 14/33*     (2006.01)
    *C12N 9/52*     (2006.01)
    *C12N 15/63*     (2006.01)
    *C12N 15/70*     (2006.01)

(52) U.S. Cl.
    CPC ............ *C12N 15/63* (2013.01); *C12N 15/70* (2013.01); *A61K 38/00* (2013.01); *C12N 2795/14143* (2013.01)

(56) References Cited

U.S. PATENT DOCUMENTS

| | | |
|---|---|---|
| 5,658,727 A | 8/1997 | Barbas et al. |
| 5,712,089 A | 1/1998 | Borrebaeck et al. |
| 5,821,047 A | 10/1998 | Garrard et al. |
| 5,880,275 A | 3/1999 | Fischhoff et al. |
| 5,965,124 A | 10/1999 | Feinberg et al. |
| 6,033,874 A | 3/2000 | Baum et al. |
| 6,156,509 A | 12/2000 | Schellenberger |
| 6,429,298 B1 | 8/2002 | Ellington et al. |
| 6,713,063 B1 | 3/2004 | Malvar et al. |
| 6,815,194 B2 | 11/2004 | Honjo et al. |
| 6,962,705 B2 | 11/2005 | Malvar et al. |
| 6,969,731 B1 | 11/2005 | Tang et al. |
| 7,064,249 B2 | 6/2006 | Corbin et al. |
| 7,070,982 B2 | 7/2006 | Malvar et al. |
| 9,023,594 B2 | 5/2015 | Liu et al. |
| 9,228,207 B2 | 1/2016 | Liu et al. |
| 9,267,127 B2 | 2/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,394,537 B2 | 7/2016 | Liu et al. |
| 9,526,784 B2 | 12/2016 | Liu et al. |
| 9,567,589 B2 | 2/2017 | Jin et al. |
| 9,737,604 B2 | 8/2017 | Jin et al. |
| 9,766,216 B2 | 9/2017 | Wada et al. |
| 9,771,574 B2 | 9/2017 | Liu et al. |
| 10,179,911 B2 | 1/2019 | Liu et al. |
| 10,227,581 B2 | 3/2019 | Liu et al. |
| 10,336,997 B2 | 7/2019 | Liu et al. |
| 10,392,674 B2 | 8/2019 | Liu et al. |
| 10,597,679 B2 | 3/2020 | Liu et al. |
| 10,612,011 B2 | 4/2020 | Liu et al. |
| 10,682,410 B2 | 6/2020 | Liu et al. |
| 10,920,208 B2 | 2/2021 | Liu et al. |
| 11,046,948 B2 | 6/2021 | Liu et al. |
| 11,078,469 B2 | 8/2021 | Liu et al. |
| 11,104,967 B2 | 8/2021 | Liu et al. |
| 11,214,792 B2 | 1/2022 | Liu et al. |
| 11,299,729 B2 | 4/2022 | Badran et al. |
| 11,447,809 B2 | 9/2022 | Bryson, Jr. et al. |
| 11,524,983 B2 | 12/2022 | Badran et al. |
| 11,624,130 B2 | 4/2023 | Liu et al. |
| 11,760,986 B2 | 9/2023 | Liu et al. |
| 2002/0132327 A1 | 9/2002 | Hay et al. |
| 2003/0119764 A1 | 6/2003 | Loeb et al. |
| 2003/0167533 A1 | 9/2003 | Yadav et al. |
| 2003/0186292 A1 | 10/2003 | MacNeil et al. |
| 2003/0203480 A1 | 10/2003 | Kovesdi et al. |
| 2005/0019753 A1 | 1/2005 | Kukolj et al. |
| 2005/0100973 A1 | 5/2005 | Steward et al. |
| 2006/0112447 A1 | 5/2006 | Bogdanova et al. |
| 2006/0160222 A1 | 7/2006 | Rozwadowski et al. |
| 2006/0166319 A1 | 7/2006 | Chan et al. |
| 2008/0220502 A1 | 9/2008 | Schellenberger et al. |
| 2009/0215110 A1 | 8/2009 | Gibson et al. |
| 2009/0227463 A1 | 9/2009 | Reif et al. |
| 2009/0300777 A1 | 12/2009 | Nakayama |
| 2010/0297180 A1 | 11/2010 | Shone |
| 2011/0177495 A1 | 7/2011 | Liu et al. |
| 2011/0318385 A1 | 12/2011 | Jackson et al. |
| 2012/0128649 A1 | 5/2012 | Chaddock et al. |
| 2012/0190825 A1 | 7/2012 | Neumann et al. |
| 2013/0059931 A1 | 3/2013 | Petersen-Mahrt et al. |
| 2013/0117869 A1 | 5/2013 | Duchateau et al. |
| 2013/0345064 A1 | 12/2013 | Liu et al. |
| 2013/0345065 A1 | 12/2013 | Liu et al. |
| 2014/0201858 A1 | 7/2014 | Ostertag et al. |
| 2015/0056177 A1 | 2/2015 | Liu et al. |
| 2015/0259721 A1 | 9/2015 | Van Brunt et al. |
| 2015/0275202 A1 | 10/2015 | Liu et al. |
| 2016/0002301 A1 | 1/2016 | Je et al. |
| 2016/0201040 A1 | 7/2016 | Liu et al. |
| 2016/0348096 A1 | 12/2016 | Liu et al. |
| 2017/0009224 A1 | 1/2017 | Liu et al. |
| 2017/0029844 A1 | 2/2017 | Ball et al. |
| 2017/0044520 A1 | 2/2017 | Liu et al. |
| 2017/0233708 A1 | 8/2017 | Liu et al. |
| 2018/0057545 A9 | 3/2018 | Liu et al. |
| 2018/0087046 A1 | 3/2018 | Liu et al. |
| 2018/0237758 A1 | 8/2018 | Liu et al. |
| 2019/0219575 A1 | 7/2019 | Gray et al. |
| 2019/0256842 A1 | 8/2019 | Liu et al. |
| 2019/0276816 A1 | 9/2019 | Liu et al. |
| 2019/0276873 A1 | 9/2019 | Dong et al. |
| 2020/0071722 A1 | 3/2020 | Liu et al. |
| 2020/0216833 A1 | 7/2020 | Liu et al. |
| 2020/0255868 A1 | 8/2020 | Liu et al. |
| 2020/0277587 A1 | 9/2020 | Liu et al. |
| 2020/0323984 A1 | 10/2020 | Liu et al. |
| 2021/0238569 A1 | 8/2021 | Liu et al. |
| 2021/0261938 A1 | 8/2021 | Liu et al. |
| 2021/0403887 A1 | 12/2021 | Liu et al. |
| 2022/0073887 A1 | 3/2022 | Liu et al. |
| 2022/0154237 A1 | 5/2022 | Liu et al. |
| 2022/0195418 A1 | 6/2022 | Liu et al. |
| 2022/0259269 A1 | 8/2022 | Liu et al. |
| 2022/0267754 A1 | 8/2022 | Liu et al. |
| 2023/0220016 A1 | 7/2023 | Liu et al. |

FOREIGN PATENT DOCUMENTS

| | | |
|---|---|---|
| JP | H09-37764 A | 2/1997 |
| JP | 2011-081011 | 4/2011 |
| WO | WO 90/02809 A1 | 3/1990 |
| WO | WO 91/17271 A1 | 11/1991 |
| WO | WO 92/01047 A1 | 1/1992 |
| WO | WO 92/09690 A2 | 6/1992 |
| WO | WO 92/15679 A1 | 9/1992 |
| WO | WO 92/18619 A1 | 10/1992 |
| WO | WO 92/20791 A1 | 11/1992 |
| WO | WO 93/01288 A1 | 1/1993 |
| WO | WO 94/18316 A2 | 8/1994 |
| WO | WO 96/04403 A1 | 2/1996 |
| WO | WO 98/32845 A1 | 7/1998 |
| WO | WO 99/23116 A1 | 5/1999 |
| WO | WO 00/71694 A1 | 11/2000 |
| WO | WO 01/05950 A2 | 1/2001 |
| WO | WO 2001/038547 A2 | 5/2001 |
| WO | WO 01/61049 A1 | 8/2001 |
| WO | WO 2005/081632 A2 | 9/2005 |
| WO | WO 2007/066923 A1 | 6/2007 |

(56) References Cited

FOREIGN PATENT DOCUMENTS

| | | |
|---|---|---|
| WO | WO 2008/005529 A2 | 1/2008 |
| WO | WO 2009/066964 A1 | 5/2009 |
| WO | WO 2009/082488 A2 | 7/2009 |
| WO | WO 2009/108180 A2 | 9/2009 |
| WO | WO 2010/028347 A2 | 3/2010 |
| WO | WO 2011/039518 A2 | 4/2011 |
| WO | WO 2011/125015 A2 | 10/2011 |
| WO | WO 2011/147590 A2 | 12/2011 |
| WO | WO 2011/066747 A1 | 6/2012 |
| WO | WO 2012/088381 A2 | 6/2012 |
| WO | WO 2012/123370 A1 | 9/2012 |
| WO | WO 2012/138927 A2 | 10/2012 |
| WO | WO 2013/047844 A1 | 4/2013 |
| WO | WO 2014/039585 A2 | 3/2014 |
| WO | WO 2014/086494 A1 | 6/2014 |
| WO | WO 2014/157820 A1 | 10/2014 |
| WO | WO 2014/158593 A1 | 10/2014 |
| WO | WO 2015/134121 A2 | 9/2015 |
| WO | WO 2015/193897 A1 | 12/2015 |
| WO | WO 2016/077052 A9 | 5/2016 |
| WO | WO-2016077052 A2 * | 5/2016 ......... C12N 15/1037 |
| WO | WO 2016/168631 A1 | 10/2016 |
| WO | WO 2017/015559 A2 | 1/2017 |
| WO | WO 2017/070632 A2 | 4/2017 |
| WO | WO 2017/136792 A2 | 8/2017 |
| WO | WO 2018/009903 A2 | 1/2018 |
| WO | WO 2018/027078 A1 | 2/2018 |
| WO | WO 2018/039438 A1 | 3/2018 |
| WO | WO 2018/056002 A1 | 3/2018 |
| WO | WO 2018/109447 A1 | 6/2018 |
| WO | WO 2018/119042 A1 | 6/2018 |
| WO | WO 2018/136939 A1 | 7/2018 |
| WO | WO 2019/040935 A1 | 2/2019 |
| WO | WO 2019/067815 A2 | 4/2019 |
| WO | WO 2019/118362 A1 | 6/2019 |
| WO | WO 2020/204836 A1 | 10/2020 |
| WO | WO 2020/252455 A1 | 12/2020 |
| WO | WO 2021/011579 A1 | 1/2021 |
| WO | WO 2023/081805 A1 | 5/2023 |

OTHER PUBLICATIONS

Sikorra et al. "Identification of the Amino Acid Residues Rendering TI-VAMP Insensitive toward Botulinum Neurotoxin B", 2006, Journal of Molecular Biology, vol. 357, p. 574-582. (Year: 2006).*
Rosenberg et al. "T7Select® Phage Display System: A powerful new protein display system based on bacteriophage T7", Dec. 1996, inNovations, No. 6, p. 1-6 (Year: 1996).*
Chen et al. "Mechanism of Substrate Recognition by Botulinum Neurotoxin Serotype A", Mar. 30, 2007, The Journal of Biological Chemistry vol. 282, No. 13, pp. 9621-9627. (Year: 2007).*
Dong et al. "Using fluorescent sensors to detect botulinum neurotoxin activity in vitro and in living cells", Oct. 12, 2004, PNAS, vol. 101 No. 41, p. 14701-14706. (Year: 2004).*
U.S. Appl. No. 13/062,098, filed Apr. 4, 2011, Liu et al.
U.S. Appl. No. 14/704,226, filed May 5, 2015, Liu et al.
U.S. Appl. No. 15/713,403, filed Sep. 22, 2017, Liu et al.
U.S. Appl. No. 13/996,208, filed Jun. 20, 2013, Liu et al.
U.S. Appl. No. 15/188,627, filed Jun. 21, 2016, Liu et al.
U.S. Appl. No. 16/410,767, filed May 13, 2019, Liu et al.
U.S. Appl. No. 15/112,759, filed Jul. 20, 2016, Liu et al.
U.S. Appl. No. 16/238,386, filed Jan. 2, 2019, Liu et al.
U.S. Appl. No. 15/217,839, filed Jul. 22, 2016, Liu et al.
U.S. Appl. No. 15/518,639, filed Apr. 12, 2017, Liu et al.
U.S. Appl. No. 15/567,312, filed Oct. 17, 2017, Liu et al.
U.S. Appl. No. 15/748,053, filed Jan. 26, 2018, Liu et al.
U.S. Appl. No. 16/804,228, filed Feb. 28, 2020, Liu et al.
U.S. Appl. No. 15/216,844, filed Jul. 22, 2016, Liu et al.
U.S. Appl. No. 16/521,371, filed Jul. 24, 2019, Liu et al.
U.S. Appl. No. 16/628,456, filed Jan. 3, 2020, Liu et al.
U.S. Appl. No. 16/648,162, filed Mar. 17, 2020, Liu et al.
EP 09812363, Mar. 30, 2012, Extended European Search Report.
EP 16203684, May 26, 2017, Extended European Search Report.
PCT/US2009/056194, Jun. 21, 2010, International Search Report and Written Opinion.
PCT/US2009/056194, Mar. 17, 2011, International Preliminary Report on Patentability.
EP 17160955, May 16, 2017, Extended European Search Report.
PCT/US2011/066747, Aug. 30, 2012, Invitation to Pay Additional Fees.
PCT/US2011/066747, Oct. 30, 2012, International Search Report and Written Opinion.
PCT/US2011/066747, Jul. 4, 2013, International Preliminary Report on Patentability.
PCT/US2015/012022, Sep. 25, 2015, International Search Report and Written Opinion.
PCT/US2015/012022, Aug. 4, 2016, International Preliminary Report on Patentability.
PCT/US2016/043559, Jan. 12, 2017, Invitation to Pay Additional Fees.
PCT/US2016/043559, Mar. 10, 2017, International Search Report and Written Opinion.
PCT/US2016/043559, Feb. 1, 2018, International Preliminary Report on Patentability.
PCT/US2015/057012, Jun. 10, 2016, International Search Report and Written Opinion.
PCT/US2015/057012, May 4, 2017, International Preliminary Report on Patentability.
PCT/US2016/027795, Aug. 11, 2016, International Search Report and Written Opinion.
PCT/US2016/027795, Oct. 26, 2017, International Preliminary Report on Patentability.
PCT/US2016/044546, Oct. 12, 2016, Invitation to Pay Additional Fees.
PCT/US2016/044546, Dec. 28, 2016, International Search Report and Written Opinion.
PCT/US2016/044546, Feb. 8, 2018, International Preliminary Report on Patentability.
PCT/US2016/043513, Nov. 30, 2016, International Search Report and Written Opinion.
PCT/US2016/043513, Feb. 1, 2018, International Preliminary Report on Patentability.
PCT/US2018/14867, Apr. 5, 2018, Invitation to Pay Additional Fees.
PCT/US2018/14867, May 23, 2018, International Search Report and Written Opinion.
PCT/US2018/14867, Aug. 1, 2019, International Preliminary Report on Patentability.
PCT/US2018/040692, Sep. 12, 2018, Invitation to Pay Additional Fees.
PCT/US2018/040692, Nov. 15, 2018, International Search Report and Written Opinion.
PCT/US2018/040692, Jan. 16, 2020, International Preliminary Report on Patentability.
PCT/US2018/051557, Jan. 4, 2019, Invitation to Pay Additional Fees.
PCT/US2018/051557, Feb. 25, 2019, International Search Report and Written Opinion.
PCT/US2018/051557, Apr. 2, 2020, International Preliminary Report on Patentability.
PCT/US2018/044242, Nov. 21, 2018, International Search Report and Written Opinion.
PCT/US2019/037216, Sep. 4, 2019, International Search Report and Written Opinion.
PCT/US2018/481134, Nov. 19, 2018, Invitation to Pay Additional Fees.
PCT/US2018/481134, Jan. 22, 2019, International Search Report and Written Opinion.
PCT/US2018/481134, Mar. 5, 2020, International Preliminary Report on Patentability.
International Preliminary Report on Patentability, mailed Dec. 24, 2020, in connection with Application No. PCT/US2019/037216.
Invitation to Pay Additional Fees, mailed Oct. 13, 2020, in connection with Application No. PCT/US2020/042016.

(56) References Cited

OTHER PUBLICATIONS

International Search Report and Written Opinion, mailed Dec. 10, 2020, in connection with Application No. PCT/US2020/042016.
Canitrot et al., Overexpression of DNA polymerase beta in cell results in a mutator phenotype and a decreased sensitivity to anticancer drugs. Proc Natl Acad Sci U S A. Oct. 13, 1998;95(21):12586-90. doi: 10.1073/pnas.95.21.12586.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Cong et al., Multiplex genome engineering using CRISPR/Cas systems. Science. 2013; 339: 819-23.
Deltcheva et al., CRISPR RNA maturation by trans-encoded small RNA and host factor RNase III. Nature. Mar. 31, 2011;471(7340):602-7. doi: 10.1038/nature09886.
Dicarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.
Ferretti et al., Complete genome sequence of an M1 strain of *Streptococcus* pyogenes. Proc Natl Acad Sci U S A. Apr. 10, 2001;98(8):4658-63. doi: 10.1073/pnas.071559398.
Guilinger et al., Fusion of catalytically inactive Cas9 to FokI nuclease improves the specificity of genome modification. Nat. Biotechnol. 2014; 32(6): 577-82. doi: 10.1038/nbt.2909. Epub Apr. 25, 2014.
Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.
Jankovic et al., Direct selection and phage display of a Gram-positive secretome. Genome Biology. Dec. 13, 2007; 8(266):1-15.
Jiang et al., RNA guided editing of bacterial genomes using CRISPR-Cas systems. Nat Biotechnol. Mar. 2013;31(3):233-9. doi: 10.1038/nbt.2508. Epub Jan. 29, 2013.
Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.
Jinek et al., RNA-programmed genome editing in human cells. Elife. Jan. 29, 2013;2:e00471. doi: 10.7554/eLife.00471.
Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19. doi: 10.1074/jbc.272.34.21408.
Mali et al., RNA-guided human genome engineering via Cas9. Science. 2013; 339:823-26.
Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46. doi: 10.1006/jmbi.1999.2605.
Radany et al., Increased spontaneous mutation frequency in human cells expressing the phage PBS2-encoded inhibitor of uracil-DNA glycosylase. Mutat Res. Sep. 15, 2000;461(1):41-58. doi: 10.1016/s0921-8777(00)00040-9.
Ziemann et al., Gene name errors are widespread in the scientific literature. Genome Biol. Aug. 23, 2016;17(1):177. doi: 10.1186/s13059-016-1044-7.
Extended European Search Report, mailed Mar. 30, 2012, in connection with Application No. EP 09812363.
Extended European Search Report, mailed May 26, 2017, in connection with Application No. EP 16203684.
International Search Report and Written Opinion, mailed Jun. 21, 2010, in connection with Application No. PCT/US2009/056194.
International Preliminary Report on Patentability, mailed Mar. 17, 2011, in connection with Application No. PCT/US2009/056194.
Extended European Search Report, mailed May 16, 2017, in connection with Application No. EP 17160955.
Invitation to Pay Additional Fees, mailed Aug. 30, 2012, in connection with Application No. PCT/US2011/066747.
International Search Report and Written Opinion, mailed Oct. 30, 2012, in connection with Application No. PCT/US2011/066747.
International Preliminary Report on Patentability, mailed Jul. 4, 2013, in connection with Application No. PCT/US2011/066747.
International Search Report and Written Opinion, mailed Sep. 25, 2015, in connection with Application No. PCT/US2015/012022.
International Preliminary Report on Patentability, mailed Aug. 4, 2016, in connection with Application No. PCT/US2015/012022.
Invitation to Pay Additional Fees, mailed Jan. 12, 2017, in connection with Application No. PCT/US/2016/043559.
International Search Report and Written Opinion, mailed Mar. 10, 2017, in connection with Application No. PCT/US/2016/043559.
International Preliminary Report on Patentability, mailed Feb. 1, 2018, in connection with Application No. PCT/US/2016/043559.
International Search Report and Written Opinion, mailed Jun. 10, 2016, in connection with Application No. PCT/US2015/057012.
International Preliminary Report on Patentability, mailed May 4, 2017, in connection with Application No. PCT/US2015/057012.
International Search Report and Written Opinion, mailed Aug. 11, 2016, in connection with Application No. PCT/US2016/027795.
International Preliminary Report on Patentability, mailed Oct. 26, 2017, in connection with Application No. PCT/US2016/027795.
Invitation to Pay Additional Fees, mailed Oct. 12, 2016, in connection with Application No. PCT/US2016/044546.
International Search Report and Written Opinion, mailed Dec. 28, 2016, in connection with Application No. PCT/US2016/044546.
International Preliminary Report on Patentability, mailed Feb. 8, 2018, in connection with Application No. PCT/US2016/044546.
International Search Report and Written Opinion, mailed Nov. 30, 2016, in connection with Application No. PCT/US2016/043513.
International Preliminary Report on Patentability, mailed Feb. 1, 2018, in connection with Application No. PCT/US2016/043513.
Invitation to Pay Additional Fees, mailed Apr. 5, 2018, in connection with Application No. PCT/US2018/14867.
International Search Report and Written Opinion, mailed May 23, 2018, in connection with Application No. PCT/US2018/14867.
International Preliminary Report on Patentability, mailed Aug. 1, 2019, in connection with Application No. PCT/US2018/14867.
Invitation to Pay Additional Fees, mailed Sep. 12, 2018, in connection with Application No. PCT/US2018/040692.
International Search Report and Written Opinion, mailed Nov. 15, 2018, in connection with Application No. PCT/US2018/040692.
International Preliminary Report on Patentability, mailed Jan. 16, 2020, in connection with Application No. PCT/US2018/040692.
Invitation to Pay Additional Fees, mailed Jan. 4, 2019, in connection with Application No. PCT/US2018/051557.
International Search Report and Written Opinion, mailed Feb. 25, 2019, in connection with Application No. PCT/US2018/051557.
International Preliminary Report on Patentability, mailed Apr. 2, 2020, in connection with Application No. PCT/US2018/051557.
International Search Report and Written Opinion, mailed Nov. 21, 2018, in connection with Application No. PCT/US2018/044242.
International Search Report and Written Opinion, mailed Sep. 4, 2019, in connection with Application No. PCT/US2019/037216.
Invitation to Pay Additional Fees, mailed Nov. 19, 2018, in connection with Application No. PCT/US2018/48134.
International Search Report and Written Opinion, mailed Jan. 22, 2019, in connection with Application No. PCT/US2018/48134.
International Preliminary Report on Patentability, mailed Mar. 5, 2020, in connection with Application No. PCT/US2018/48134.
[No Author Listed] NCBI Accession No. XP_015843220.1. C ->U editing enzyme APOBEC-1 [*Peromyscus maniculatus bairdii*], XP002793540.
[No Author Listed] Ncbi Accession No. XP_021505673.1. C ->U editing enzyme APOBEC-1 [*Meriones unguiculatus*], XP002793541.
Ahluwalia et al., Hypermutability and error catastrophe due to defects in ribonucleotide reductase. Proc Natl Acad Sci U S A. Nov. 12, 2013;110(46):18596-601. doi: 10.1073/pnas.1310849110. Epub Oct. 28, 2013.
Akopian et al., Chimeric recombinases with designed DNA sequence recognition. Proc Natl Acad Sci U S A. Jul. 22, 2003;100(15):8688-91. Epub Jul. 1, 2003.
Armstrong et al., Chapter 3. Vectors for Phage Display. In: Phage Display of Peptides and Proteins. Kay et al., eds. Academic Press. San Diego, CA. 1996:35-53.

(56) References Cited

OTHER PUBLICATIONS

Bade et al., Botulinum neurotoxin type D enables cytosolic delivery of enzymatically active cargo proteins to neurones via unfolded translocation intermediates. J Neurochem. Dec. 2004;91(6):1461-72.

Badran et al., Continuous evolution of Bacillus thuringiensis toxins overcomes insect resistance. Nature. May 5, 2016;533(7601):58-63. doi: 10.1038/nature17938. Epub Apr. 27, 2016.

Badran et al., Development of potent in vivo mutagenesis plasmids with broad mutational spectra. Nat Commun. Oct. 7, 2015;6:8425. doi: 10.1038/ncomms9425.

Badran et al., In vivo continuous directed evolution. Curr Opin Chem Biol. Feb. 2015;24:1-10. doi: 10.1016/j.cbpa.2014.09.040. Epub Nov. 7, 2014.

Baker et al., Chemical complementation: a reaction-independent genetic assay for enzyme catalysis. Proc Natl Acad Sci U S A. Dec. 24, 2002;99(26):16537-42. Epub Dec. 13, 2002.

Barbas et al., Assembly of combinatorial antibody libraries on phage surfaces: the gene III site. Proc Natl Acad Sci U S A. Sep. 15, 1991;88(18):7978-82.

Bennet et al., Unlocking of the filamentous bacteriophage virion during infection is mediated by the C domain of pIII. J Mol Biol. Feb. 17, 2006;356(2):266-73. Epub Dec. 9, 2005.

Binz et al., Clostridial neurotoxins: mechanism of SNARE cleavage and outlook on potential substrate specificity reengineering. Toxins. Apr. 2010;2(4):665-82. Epub Apr. 13, 2010.

Birling et al., Site-specific recombinases for manipulation of the mouse genome. Methods Mol Biol. 2009;561:245-63. doi: 10.1007/978-1-60327-019-9_16.

Bloom et al., Evolving strategies for enzyme engineering. Curr Opin Struct Biol. Aug. 2005;15(4):447-52.

Boch et al., Breaking the code of DNA binding specificity of TAL-type III effectors. Science. Dec. 11, 2009;326(5959):1509-12. doi: 10.1126/science.1178811.

Boeke et al., Effects of bacteriophage f1 gene III protein on the host cell membrane. Mol Gen Genet. 1982;186(2):185-92.

Boersma et al., Selection strategies for improved biocatalysts. FEBS J. May 2007;274(9):2181-95.

Bolusani et al., Evolution of variants of yeast site-specific recombinase Flp that utilize native genomic sequences as recombination target sites. Nucleic Acids Res. 2006;34(18):5259-69. Epub Sep. 26, 2006.

Braun et al., Immunogenic duplex nucleic acids are nuclease resistant. J Immunol. Sep. 15, 1988;141(6):2084-9.

Breaker et al., Emergence of a replicating species from an in vitro RNA evolution reaction. Proc Natl Acad Sci U S A. Jun. 21, 1994;91(13):6093-7.

Brieba et al., Role of T7 RNA polymerase His784 in start site selection and initial transcription. Biochemistry. Apr. 23, 2002;41(16):5144-9.

Buchholz et al., Alteration of Cre recombinase site specificity by substrate-linked protein evolution. Nat Biotechnol. Nov. 2001;19(11):1047-52.

Cadwell et al., Randomization of Genes by PCR Mutagenesis. PCR Methods Applic. 1992;2:28-33.

Camps et al., Targeted gene evolution in *Escherichia coli* using a highly error-prone DNA polymerase I. Proc Natl Acad Sci U S A. Aug. 19, 2003;100(17):9727-32. Epub Aug. 8, 2003.

Cao et al., Characterization of the transgenic rice event TT51-1 and construction of a reference plasmid. J Agric Food Chem. Aug. 24, 2011;59(16):8550-9. doi: 10.1021/jf201699s. Epub Jul. 21, 2011.

Carlson et al., Negative selection and stringency modulation in phage-assisted continuous evolution. Nat Chem Biol. Mar. 2014;10(3):216-22. doi: 10.1038/nchembio.1453. Epub Feb. 2, 2014. With Supplementary Results.

Cattaneo et al., SEL1L affects human pancreatic cancer cell cycle and invasiveness through modulation of PTEN and genes related to cell-matrix interactions. Neoplasia. 2005;7(11):1030-1038.

Chaddock et al., Inhibition of vesicular secretion in both neuronal and nonneuronal cells by a retargeted endopeptidase derivative of Clostridium botulinum neurotoxin type A. Infect. Immun. May 2000;68(5):2587-93.

Chaineau et al., Multiple roles of the vesicular-SNARE TI-VAMP in post-Golgi and endosomal trafficking. FEBS Letters. Oct. 2009;583:3817-26.

Chasteen et al., Eliminating helper phage from phage display. Nucleic Acids Res. 2006;34(21):e145. Epub Nov. 6, 2006.

Chaturvedi et al., Stabilization of triple-stranded oligonucleotide complexes: use of probes containing alternating phosphodiester and stereo-uniform cationic phosphoramidate linkages. Nucleic Acids Res. Jun. 15, 1996;24(12):2318-23.

Cheetham et al., Structural basis for initiation of transcription from an RNA polymerase-promoter complex. Nature. May 6, 1999;399(6731):80-3.

Chen et al., Engineering botulinum neurotoxin to extend therapeutic intervention. PNAS. Jun. 2009;106(23):9180-4.

Chen et al., Information theory based T7-like promoter models: classification of bacteriophages and differential evolution of promoters and their polymerases. Nucleic Acids Res. Oct. 31, 2005;33(19):6172-87. Print 2005.

Chen et al., VAMP8 facilitates cellular proliferation and temozolomide resistance in human glioma cells. Neuro-Oncology. 2015;17(3):407-18. Epub Sep. 10, 2014.

Chen, Clinical uses of botulinum neurotoxins: current indications, limitations and future developments. Toxins (Basel). 2012;4(10):913-939.

Clackson et al., Making antibody fragments using phage display libraries. Nature. Aug. 15, 1991;352(6336):624-8.

Click et al., Filamentous phage infection: required interactions with the TolA protein. J Bacteriol. Oct. 1997;179(20):6464-71.

Cobb et al., Directed evolution: an evolving and enabling synthetic biology tool. Curr Opin Chem Biol. Aug. 2012;16(3-4):285-91. doi: 10.1016/j.cbpa.2012.05.186. Epub Jun. 4, 2012.

Corey et al., Trypsin display on the surface of bacteriophage. Gene. Jun. 15, 1993;128(1):129-34.

Craik et al., Proteases as therapeutics. Biochem J. Apr. 2011;435(1):16 pages.

Crameri et al., Display of biologically active proteins on the surface of filamentous phages: a cDNA cloning system for selection of functional gene products linked to the genetic information responsible for their production. Gene. Dec. 27, 1993;137(1):69-75.

Cwirla et al., Peptides on phage: a vast library of peptides for identifying ligands. Proc Natl Acad Sci U S A. Aug. 1990;87(16):6378-82.

Das et al., Viral evolution as a tool to improve the tetracycline-regulated gene expression system. J Biol Chem. Apr. 30, 2004;279(18):18776-82. Epub Feb. 2, 2004.

Datsenko et al., One-step inactivation of chromosomal genes in *Escherichia coli* K-12 using PCR products. Proc Natl Acad Sci U S A. Jun. 6, 2000;97(12):6640-5.

Davis et al., Viral mutagenesis as a means for generating novel proteins. J Virol. Feb. 2010;84(3):1625-30. Epub Nov. 11, 2009.

De Haard et al., A large non-immunized human Fab fragment phage library that permits rapid isolation and kinetic analysis of high affinity antibodies. J Biol Chem. Jun. 25, 1999;274(26):18218-30.

Deribe, Mechanistic insights into the role of truncating PREX2 mutations in melanoma. Mol Cell Oncol. 2016;3(3):e1160174. 3 pages.

Deussing, Targeted mutagenesis tools for modelling psychiatric disorders. Cell Tissue Res. Oct. 2013;354(1):9-25. doi: 10.1007/s00441-013-1708-5. Epub Sep. 10, 2013.

Dickinson et al., A system for the continuous directed evolution of proteases rapidly reveals drug-resistance mutations. Nat Commun. Oct. 30, 2014;5:5352. doi: 10.1038/ncomms6352. 8 pages.

Dickinson et al., Experimental interrogation of the path dependence and stochasticity of protein evolution using phage-assisted continuous evolution. Proc Natl Acad Sci USA. May 2013;110(22):9007-12.

Dove et al., Conversion of the omega subunit of *Escherichia coli* RNA polymerase into a transcriptional activator or an activation target. Genes Dev. Mar. 1, 1998;12(5):745-54.

(56) References Cited

OTHER PUBLICATIONS

Doyon et al., Directed evolution and substrate specificity profile of homing endonuclease I-SceI. J Am Chem Soc. Feb. 22, 2006;128(7):2477-84.

Drake, A constant rate of spontaneous mutation in DNA-based microbes. Proc Natl Acad Sci USA. Aug. 15, 1991;88(16):7160-4.

Duggan et al., Inhibition of Release of Neurotransmitters from Rat Dorsal Root Ganglia by a Novel Conjugate of a Clostridium botulinum Toxin A Endopeptidase Fragment and Erythrina cristagalli Lectin. The Journal of Biological Chemistry. Sep. 2002;277(38):34846-52.

Durai et al., A bacterial one-hybrid selection system for interrogating zinc finger-DNA interactions. Comb Chem High Throughput Screen. May 2006;9(4):301-11.

Durniak et al., The structure of a transcribing T7 RNA polymerase in transition from initiation to elongation. Science. Oct. 24, 2008;322(5901):553-7.

Esvelt et al., A system for the continuous directed evolution of biomolecules. Nature. Apr. 28, 2011;472(7344):499-503. Epub Apr. 10, 2011.

Feng et al., Exo1: A new chemical inhibitor of the exocytic pathway. PNAS. May 2003;100(11):6469-74.

Fijalkowska et al., Mutants in the Exo I motif of *Escherichia coli* dnaQ: defective proofreading and inviability due to error catastrophe. Proc Natl Acad Sci U S A. Apr. 2, 1996;93(7):2856-61.

Foster et al., Re-engineering the target specificity of Clostridial neurotoxins-A route to novel therapeutics. Neurotoxicity Research. May 2006;9(2,3):101-7.

Foster et al., Targeted Secretion Inhibitors—Innovative Protein Therapeutics. Toxins. Dec. 2010;2:2795-815.

Fowlkes et al., Multipurpose vectors for peptide expression on the M13 viral surface. Biotechniques. Sep. 1992;13(3):422-8.

Friedberg et al., Error-prone DNA polymerases: novel structures and the benefits of infidelity. Cell. Oct. 5, 2001;107(1):9-12.

Fu et al., Promises and Pitfalls of Intracellular Delivery of Proteins. Bioconjugate Chemistry. Aug. 2014;25:1602-8.

Fuchs et al., Targeting Recombinant Antibodies to the Surface of *Escherichia coli*: Fusion to a Peptidoglycan Associated Lipoprotein. Bio/Technology. 1991;9:1370-72.

Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.

Garrard et al., Fab assembly and enrichment in a monovalent phage display system. Biotechnology (N Y). Dec. 1991;9(12):1373-7.

Gibson et al., Enzymatic assembly of DNA molecules up to several hundred kilobases. Nat Methods. May 2009;6(5):343-5. Epub Apr. 12, 2009.

Gill, Bacterial Toxins: a Table of Letal Amounts. Microbiological Reviews. Mar. 1982;46(1):86-94.

Goodnough et al., Development of a delivery vehicle for intracellular transport of botulinum neurotoxin antagonists. FEBS Lett. Feb. 27, 2002;513(2-3):163-8.

Gordley et al., Evolution of programmable zinc finger-recombinases with activity in human cells. J Mol Biol. Mar. 30, 2007;367(3):802-13. Epub Jan. 12, 2007.

Gram et al., In vitro selection and affinity maturation of antibodies from a naive combinatorial immunoglobulin library. Proc Natl Acad Sci U S A. Apr. 15, 1992;89(8):3576-80.

Griffiths et al., Human anti-self antibodies with high specificity from phage display libraries. EMBO J. Feb. 1993;12(2):725-34.

Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.

Guzman et al., Tight regulation, modulation, and high-level expression by vectors containing the arabinose PBAD promoter. J Bacteriol. 1995;177(14):4121-4130.

Harris et al., Measurement of enzyme activity. Methods Enzymol. 2009;463:57-71.

Hart et al., Directed Evolution to Investigate Steric Control of Enzymatic Oxidosqualene Cyclization. An Isoleucine-to-Valine Mutation in Cycloartenol Synthase Allows Lanosterol and Parkeol Biosynthesis. J Am Chem Soc. 1999;121:9887-88.

Hawkins et al., Selection of phage antibodies by binding affinity. Mimicking affinity maturation. J Mol Biol. Aug. 5, 1992;226(3):889-96.

Hay et al., Bacteriophage cloning and *Escherichia coli* expression of a human IgM Fab. Hum Antibodies Hybridomas. Apr. 1992;3(2):81-5.

Hendricks et al., The *S. cerevisiae* Mag1 3-methyladenine DNA glycosylase modulates susceptibility to homologous recombination. DNA Repair (Amst). 2002;1(8):645-659.

Ho et al., Recombinant botulinum neurotoxin A heavy chainbased delivery vehicles for neuronal cell targeting. Protein Engineering, Design & Selection. 2011;24(3):247-53. Epub Nov. 4, 2010.

Hoogenboom et al., Antibody phage display technology and its applications. Immunotechnology. Jun. 1998;4(1):1-20.

Hoogenboom et al., Multi-subunit proteins on the surface of filamentous phage: methodologies for displaying antibody (Fab) heavy and light chains. Nucleic Acids Res. Aug. 11, 1991;19(15):4133-7.

Hoogenboom et al., Natural and designer binding sites made by phage display technology. Immunol Today. Aug. 2000;21(8):371-8.

Houshmand et al., Use of Bateriophage T7 Displayed Peptides for Determination of Monoclonal Anitbody Specificity and Biosensor Analysis of the Binding Reaction. Anal Biochem. 1999;268:363-70.

Hu et al., *Escherichia coli* one- and two-hybrid systems for the analysis and identification of protein-protein interactions. Methods. Jan. 2000;20(1):80-94.

Hubbard et al., Continuous directed evolution of DNA-binding proteins to improve TALEN specificity. Nat Methods. Oct. 2015;12(10):939-42. doi: 10.1038/nmeth.3515. Epub Aug. 10, 2015. With Supplementary Information.

Huse et al., Generation of a large combinatorial library of the immunoglobulin repertoire in phage lambda. Science. Dec. 8, 1989;246(4935):1275-81.

Husimi et al., Cellstat—a continuous culture system of a bacteriophage for the study of the mutation rate and the selection process of the DNA level. Rev Sci Instrum. Apr. 1982;53(4):517-22.

Husimi, Selection and evolution of bacteriophages in cellstat. Adv Biophys. 1989;25:1-43.

Ichetovkin et al., Substrate recognition by the leucyl/phenylalanyl-tRNA-protein transferase. Conservation within the enzyme family and localization to the trypsin-resistant domain. J Biol Chem. Dec. 26, 1997;272(52):33009-14.

Ikeda et al., In vivo and in vitro activities of point mutants of the bacteriophage T7 RNA polymerase promoter. Biochemistry. Sep. 22, 1992;31(37):9073-80.

Ikeda et al., Selection and characterization of a mutant T7 RNA polymerase that recognizes an expanded range of T7 promoter-like sequences. Biochemistry. Sep. 7, 1993;32(35):9115-24.

Imburgio et al., Studies of promoter recognition and start site selection by T7 RNA polymerase using a comprehensive collection of promoter variants. Biochemistry. Aug. 29, 2000;39(34):10419-30.

Irion et al., Identification and targeting of the ROSA26 locus in human embryonic stem cells. Nat Biotechnol. Dec. 2007;25(12):1477-82. Epub Nov. 25, 2007.

Johns et al., The promise and peril of continuous in vitro evolution. J Mol Evol. Aug. 2005;61(2):253-63. Epub Jun. 27, 2005.

Joho et al., Identification of a region of the bacteriophage T3 and T7 RNA polymerases that determines promoter specificity. J Mol Biol. Sep. 5, 1990;215(1):31-9.

Joung et al., A bacterial two-hybrid selection system for studying protein-DNA and protein-protein interactions. Proc Natl Acad Sci U S A. Jun. 20, 2000;97(13):7382-7.

Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.

(56) References Cited

OTHER PUBLICATIONS

Kawarasaki et al., Enhanced crossover SCRATCHY: construction and high-throughput screening of a combinatorial library containing multiple non-homologous crossovers. Nucleic Acids Res. Nov. 1, 2003;31(21):e126.

Khlebnikov et al., Modulation of gene expression from the arabinose-inducible araBAD promoter. J Ind Microbiol Biotechnol. Jul. 2002;29(1):34-7.

Kim et al., DJ-1, a novel regulator of the tumor suppressor PTEN. Cancer Cell. 2005;7(3):263-273.

Kim et al., Increasing the genome-targeting scope and precision of base editing with engineered Cas9-cytidine deaminase fusions. Nature Biotechnology; Feb. 13, 2007; 35(4): 371-376.

Klement et al., Discrimination between bacteriophage T3 and T7 promoters by the T3 and T7 RNA polymerases depends primarily upon a three base-pair region located 10 to 12 base-pairs upstream from the start site. J Mol Biol. Sep. 5, 1990;215(1):21-9.

Köhler, A yeast-based growth assay for the analysis of site-specific proteases. Nucleic Acids Res. 2003;31(4):e16. 5 pages.

Komor et al., Programmable editing of a target base in genomic DNA without double-stranded DNA cleavage. Nature. May 19, 2016;533(7603):420-4. doi: 10.1038/nature17946. Epub Apr. 20, 2016.

Kozak et al., Structural features in eukaryotic mRNAs that modulate the initiation of translation. J Biol Chem. Oct. 25, 1991;266(30):19867-70.

Kuzmine et al., Binding of the priming nucleotide in the initiation of transcription by T7 RNA polymerase. J Biol Chem. Jan. 31, 2003;278(5):2819-23. Epub Nov. 9, 2002.

Laskowska et al., IbpA and IbpB, the new heat-shock proteins, bind to endogenous *Escherichia coli* proteins aggregated intracellularly by heat shock. Biochimie. 1996;78(2):117-22.

Latimer et al., Specificity of monoclonal antibodies produced against phosphorothioate and ribo modified DNAs. Mol Immunol. Oct. 1995;32(14-15):1057-64.

Lebeda et al., The Zinc-Dependent Protease Activity of the Botulinum Neurotoxins. Toxins. May 2010;2:978-97.

Leconte et al., A population-based experimental model for protein evolution: effects of mutation rate and selection stringency on evolutionary outcomes. Biochemistry. Feb. 26, 2013; 52(8): 1490-1499.

Lei et al., Efficient targeted gene disruption in Xenopus embryos using engineered transcription activator-like effector nucleases (TALENs). PNAS Oct. 23, 2012;109(43):17484-17489; https://doi.org/10.1073/pnas.1215421109.

Lincoln et al., Self-sustained replication of an RNA enzyme. Science. Feb. 27, 2009;323(5918):1229-32. Epub Jan. 8, 2009.

Lindemann et al., Evolution of bacteriophage in continuous culture: a model system to test antiviral gene therapies for the emergence of phage escape mutants. J Virol. Jun. 2002;76(11):5784-92.

Lu, The destructive effect of botulinum neurotoxins on the SNARE protein: SNAP-25 and synaptic membrane fusion. PeerJ. 2015;3:e1065. Published Jun. 30, 2015.

Lutz et al., Creating multiple-crossover DNA libraries independent of sequence identity. Proc Natl Acad Sci U S A. Sep. 25, 2001;98(20):11248-53. Epub Sep. 18, 2001.

Maeder et al., Robust, synergistic regulation of human gene expression using TALE activators. Nat Methods. Mar. 2013;10(3):243-5. doi: 10.1038/nmeth.2366. Epub Feb. 10, 2013.

Makeyev et al., Evolutionary potential of an RNA virus. J Virol. Feb. 2004;78(4):2114-20.

Malmborg et al., Selective phage infection mediated by epitope expression on F pilus. J Mol Biol. Oct. 31, 1997;273(3):544-51.

Martin et al., Kinetic analysis of T7 RNA polymerase-promoter interactions with small synthetic promoters. Biochemistry. May 19, 1987;26(10):2690-6.

Masuyer et al., Engineered botulinum neurotoxins as new therapeutics. Annu Rev Pharmacol Toxicol. 2014;54:27-51.

McCafferty et al., Phage antibodies: filamentous phage displaying antibody variable domains. Nature. Dec. 6, 1990;348(6301):552-4.

McConnell et al., Constrained peptide libraries as a tool for finding mimotopes. Gene. Dec. 30, 1994;151(1-2):115-8.

McNaughton et al., Mammalian cell penetration, siRNA transfection, and DNA transfection by supercharged proteins. Proc Natl Acad Sci U S A. Apr. 14, 2009;106(15):6111-6. doi: 10.1073/pnas.0807883106. Epub Mar. 23, 2009.

Mihai et al., PTEN inhibition improves wound healing in lung epithelia through changes in cellular mechanics that enhance migration. Am J Physiol Lung Cell Mol Physiol. 2012;302(3):L287-L299.

Miller et al., A Tale nuclease architecture for efficient genome editing. Nat Biotechnol. Feb. 2011;29(2):143-8. doi:10.1038/nbt.1755. Epub Dec. 22, 2010.

Milligan et al., Oligoribonucleotide synthesis using T7 RNA polymerase and synthetic DNA templates. Nucleic Acids Res. Nov. 11, 1987;15(21):8783-98.

Mills et al., An extracellular Darwinian experiment with a self-duplicating nucleic acid molecule. Proc Natl Acad Sci U S A. Jul. 1967;58(1):217-24.

Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.

Nelson et al., Filamentous phage DNA cloning vectors: a noninfective mutant with a nonpolar deletion in gene III. Virology. Jan. 30, 1981;108(2):338-50.

Nern et al., Multiple new site-specific recombinases for use in manipulating animal genomes. Proc Natl Acad Sci U S A. Aug. 23, 2011;108(34):14198-203. doi: 10.1073/pnas.1111704108. Epub Aug. 9, 2011.

O'Maille et al., Structure-based combinatorial protein engineering (SCOPE). J Mol Biol. Aug. 23, 2002;321(4):677-91.

Oeemig et al., Solution structure of DnaE intein from Nostoc punctiforme: structural basis for the design of a new split intein suitable for site-specific chemical modification. FEBS Lett. May 6, 2009;583(9):1451-6.

Opperman et al., A model for a umuDC-dependent prokaryotic DNA damage checkpoint. Proc Natl Acad Sci U S A. Aug. 3, 1999;96(16):9218-23.

Ostendorf et al., Characterization of a dam mutant of Serratia marcescens and nucleotide sequence of the dam region. J Bacteriol. Jul. 1999;181(13):3880-5.

Ostermeier et al., A combinatorial approach to hybrid enzymes independent of DNA homology. Nat Biotechnol. Dec. 1999;17(12):1205-9.

Peyrottes et al., Oligodeoxynucleoside phosphoramidates (P-NH2): synthesis and thermal stability of duplexes with DNA and RNA targets. Nucleic Acids Res. May 15, 1996;24(10):1841-8.

Pickett et al., Towards New Uses of Botulinum Toxin as a Novel Therapeutic Tool. Toxins. Jan. 2011;3:63-81.

Pogson et al., Engineering Next Generation Proteases. Curr Opin Biotechnol. Aug. 2009;20(4):390-7.

Pu et al., Evolution of a split RNA polymerase as a versatile biosensor platform. Nat Chem Biol. Apr. 2017;13(4):432-438. doi: 10.1038/nchembio.2299. Epub Feb. 13, 2017.

Rakonjac et al., Filamentous phage are released from the bacterial membrane by a two-step mechanism involving a short C-terminal fragment of pIII. J Mol Biol. Jun. 25, 1999;289(5):1253-65.

Rakonjac et al., Filamentous phage infection-mediated gene expression: construction and propagation of the gIII deletion mutant helper phage R408d3. Gene. Oct. 1, 1997;198(1-2):99-103.

Rakonjac et al., Roles of pIII in filamentous phage assembly. J Mol Biol. Sep. 11, 1998;282(1):25-41.

Raskin et al., Substitution of a single bacteriophage T3 residue in bacteriophage T7 RNA polymerase at position 748 results in a switch in promoter specificity. J Mol Biol. Nov. 20, 1992;228(2):506-15.

Raskin et al., T7 RNA polymerase mutants with altered promoter specificities. Proc Natl Acad Sci U S A. Apr. 15, 1993;90(8):3147-51.

Rawlings et al., MEROPS: the database of proteolytic enzymes, their substrates and inhibitors. Nucleic Acids Res. Jan. 2014;42(Database issue):D503-9.

(56) References Cited

OTHER PUBLICATIONS

Rebar et al., Phage display methods for selecting zinc finger proteins with novel DNA-binding specificities. Methods Enzymol. 1996;267:129-49.
Reidhaar-Olson et al., Random mutagenesis of protein sequences using oligonucleotide cassettes. Methods Enzymol. 1991;208:564-86.
Reuven et al., Lesion bypass by the *Escherichia coli* DNA polymerase V requires assembly of a RecA nucleoprotein filament. J Biol Chem. Feb. 23, 2001;276(8):5511-7. Epub Nov. 17, 2000.
Riechmann et al., The C-terminal domain of TolA is the coreceptor for filamentous phage infection of *E. coli*. Cell. Jul. 25, 1997;90(2):351-60.
Ringquist et al., Translation initiation in *Escherichia coli*: sequences within the ribosome-binding site. Mol Microbiol. May 1992;6(9):1219-29.
Rosenberg et al., T7 Select® Phage Display System: A Powerful new protein display system based on bacteriophage T7. Innovations. 1996;6:1-6.
Santini et al., Efficient display of an HCV cDNA expression library as C-terminal fusion to the capsid protein D of bacteriophage lambda. J Mol Biol. Sep. 11, 1998;282(1):125-35.
Santoro et al., Directed evolution of the site specificity of Cre recombinase. Proc Natl Acad Sci U S A. Apr. 2, 2002;99(7):4185-90. Epub Mar. 19, 2002.
Schultz et al., Oligo-2'-fluoro-2'-deoxynucleotide N3'→P5' phosphoramidates: synthesis and properties. Nucleic Acids Res. Aug. 1, 1996;24(15):2966-73.
Scott et al., Searching for peptide ligands with an epitope library. Science. Jul. 27, 1990;249(4967):386-90.
Sices et al., A genetic screen for the isolation and characterization of site-specific proteases. Proc Natl Acad Sci U S A. Mar. 17, 1998;95(6):2828-33.
Sices et al., Rapid genetic selection of inhibitor-resistant protease mutants: clinically relevant and novel mutants of the HIV protease. AIDS Res Hum Retroviruses. Sep. 1, 2001;17(13):1249-55.
Sieber et al., Libraries of hybrid proteins from distantly related sequences. Nat Biotechnol. May 2001;19(5):456-60.
Sikorra et al., Substrate Recognition Mechanism of VAMP/Synaptobrevin-cleaving Clostridial Neurotoxins. Journal of Biological Chemistry. 2008;283:21145-52. Epub May 29, 2008.
Silva et al., Selective disruption of the DNA polymerase III α-β complex by the umuD gene products. Nucleic Acids Res. Jul. 2012;40(12):5511-22. doi: 10.1093/nar/gks229. Epub Mar. 9, 2012.
Smith, Filamentous fusion phage: novel expression vectors that display cloned antigens on the virion surface. Science. Jun. 14, 1985;228(4705):1315-7.
Somm et al., A botulinum toxin—drived targeted secretion inihibitor downregulates the GH/IGF1 axis. The Journal of Clinical Investigation. Sep. 2012;122(9):3295-306.
Steffen et al., MT1-MMP-Dependent Invasion is Regulated by TI-VAMP/VAMP7. Current Biology. Jun. 2008;18:926-31.
Stemmer, Rapid evolution of a protein in vitro by DNA shuffling. Nature. Aug. 4, 1994;370(6488):389-91.
Sutter et al., Non-replicating vaccinia vector efficiently expresses bacteriophage T7 RNA polymerase. FEBS Lett. Aug. 28, 1995;371(1):9-12.
Torres et al., Non-integrative lentivirus drives high-frequency cre-mediated cassette exchange in human cells. PLoS One. 2011;6(5):e19794. doi: 10.1371/journal.pone.0019794. Epub May 23, 2011.
Tracewell et al., Directed enzyme evolution: climbing fitness peaks one amino acid at a time. Curr Opin Chem Biol. Feb. 2009;13(1):3-9. doi: 10.1016/j.cbpa.2009.01.017. Epub Feb. 25, 2009.
Tsai et al., Targeting botulinum neurotoxin persistence by the ubiquitin-proteasome system. PNAS. Sep. 2010;107(38):16554-9.
Tsuji et al., Random multi-recombinant PCR for the construction of combinatorial protein libraries. Nucleic Acids Res. Oct. 15, 2001;29(20):E97.

Tzagoloff et al., The Initial Steps in Infection With Coliphage M13. Virology. Nov. 1964;24:372-80.
Varadarajan et al., Engineering of protease variants exhibiting high catalytic activity and exquisite substrate selectivity. PNAS. May 2005;102(19):6855-60.
Varadarajan et al., Highly active and selective endopeptidases with programmed substrate specificities. Nat Chem Biol. May 2008;4(5):290-4.
Vidal et al., Yeast forward and reverse 'n'-hybrid systems. Nucleic Acids Res. Feb. 15, 1999;27(4):919-29.
Vidal-Aroca et al., One-step high-throughput assay for quantitative detection of beta-galactosidase activity in intact gram-negative bacteria, yeast, and mammalian cells. Biotechniques. Apr. 2006;40(4):433-4, 436, 438 passim.
Voigt et al., Rational evolutionary design: the theory of in vitro protein evolution. Adv Protein Chem. 2000;55:79-160.
Voytek et al., Emergence of a fast-reacting ribozyme that is capable of undergoing continuous evolution. Proc Natl Acad Sci U S A. Sep. 25, 2007;104(39):15288-93. Epub Sep. 18, 2007.
Wang et al., Continuous directed evolutions of proteins with improved soluble expression. Nature Chemical Biology. Nat Publishing Group. Aug. 20, 2018; 14(10):972-980.
Wang et al., Evolution of new nonantibody proteins via iterative somatic hypermutation. Proc Natl Acad Sci U S A. Nov. 30, 2004;101(48):16745-9. Epub Nov. 19, 2004.
Wang et al., Programming cells by multiplex genome engineering and accelerated evolution. Nature. Aug. 13, 2009;460(7257):894-8. Epub Jul. 26, 2009.
Wang et al., Syntaxin Requirement for Ca2+-Triggered Exocytosis in Neurons and Endocrine Cells Demonstrated with an Engineered Neurotoxin. Boiochemistry. Apr. 2011;50(14):2711-9.
Webb et al., Production of catalytically inactive BoNT/A1 holoprotein and comparison with BoNT/A1 subunit vaccines against toxin subtypes A1, A2, and A3. Vaccine. 2009;27(33):4490-4497.
Wharton et al., A new-specificity mutant of 434 repressor that defines an amino acid-base pair contact. Nature. Apr. 30-May 6, 1987;326(6116):888-91.
Wharton et al., Changing the binding specificity of a repressor by redesigning an alpha-helix. Nature. Aug. 15-21, 1985;316(6029):601-5.
Williams et al., SNAP23, Syntaxin4, and vesicle-associated membrane protein 7 (VAMP7) mediate trafficking of membrane type 1-matrix metalloproteinase (MT1-MMP) during invadopodium formation and tumor cell invasion. MBoC. Jul. 2014;25:2061-70.
Wright et al., Continuous in vitro evolution of catalytic function. Science. Apr. 25, 1997;276(5312):614-7.
Yamamoto et al., Virological and immunological bases for HIV-1 vaccine design. Uirusu 2007;57(2):133-139. https://doi.org/10.2222/jsv.57.133.
Yeh et al., Retargeted Clostridial neurotoxins as Novel Agents for Treating Chronic Diseases. Biochemistry. Nov. 2011;50:10419-21.
Yi et al., Engineering of TEV protease variants by yeast ER sequestration screening (YESS) of combinatorial libraries. PNAS. Apr. 2013;110(18):7229-34.
Yuan et al., Laboratory-directed protein evolution. Microbiol Mol Biol Rev. Sep. 2005;69(3):373-92.
Zhou et al., Optimization of the Tet-On system for regulated gene expression through viral evolution. Gene Ther. Oct. 2006;13(19):1382-90. Epub May 25, 2006.
Partial European Search Report for Application No. 18847527.1, mailed Apr. 21, 2021.
Extended European Search Report for Application No. 18847527.1, mailed Aug. 2, 2021.
International Preliminary Report on Patentability mailed Jan. 27, 2022, in connection with Application No. PCT/US2020/042016.
Blum et al., Phage-assisted evolution of botulinum neurotoxin proteases with reprogrammed specificity. Science. Feb. 19, 2021;371(6531):803-810. doi: 10.1126/science.abf5972.
Blum, Continuous evolution of bacterial neurotoxins for intracellular protease therapy. 2019. Poster. 1 page.
Blum, Generation of selective botulinum neurotoxin proteases with reprogrammed substrate specificity through phage-assisted directed evolution. Apr. 7, 2020. Powerpoint. 36 pages.

(56) References Cited

OTHER PUBLICATIONS

Blum, Generation of selective botulinum neurotoxin proteases with reprogrammed substrate specificity through phage-assisted directed evolution. Jun. 4, 2019. Powerpoint. 24 pages.

Kasai et al., Distinct initial SNARE configurations underlying the diversity of exocytosis. Physiol Rev. Oct. 2012;92(4):1915-64. doi: 10.1152/physrev.00007.2012.

Liu et al., PTEN deletion enhances the regenerative ability of adult corticospinal neurons. Nat Neurosci. Sep. 2010;13(9):1075-81. doi: 10.1038/nn.2603. Epub Aug. 8, 2010.

Meng et al., Role of SNARE proteins in tumourigenesis and their potential as targets for novel anti-cancer therapeutics. Biochim Biophys Acta. Aug. 2015;1856(1):1-12. doi: 10.1016/j.bbcan.2015.04.002. Epub May 5, 2015.

Ngo et al., Computational Complexity, Protein Structure Prediction, and the Levinthal Paradox in The Protein Folding Problem and Tertiary Structure Prediction. Merz et al., Eds. 1994. pp. 433 and 492-495.

Nicholson-Fish et al., VAMP4 Is an Essential Cargo Molecule for Activity-Dependent Bulk Endocytosis. Neuron. Dec. 2, 2015;88(5):973-984. doi: 10.1016/j.neuron.2015.10.043. Epub Nov. 19, 2015.

Raingo et al., VAMP4 directs synaptic vesicles to a pool that selectively maintains asynchronous neurotransmission. Nat Neurosci. Mar. 11, 2012;15(5):738-45. doi: 10.1038/nn.3067.

Ruiz-Martinez et al., YKT6 expression, exosome release, and survival in non-small cell lung cancer. Oncotarget. Aug. 9, 2016;7(32):51515-51524. doi: 10.18632/oncotarget.9862.

Vincenzeti et al, Functional properties of subunit interactions in human cytidine deaminase. Protein Engi. Dec. 2003;16(12):1055-61. doi: 10.1093/protein/gzg117.

Vincenzeti et al, Possible role of two phenylalanine residues in the active site of human cytidine deaminase. Protein Eng. Nov. 2000;13(11):791-9. doi: 10.1093/protein/13.11.791.

Zhang et al., Identification and characterization of a novel botulinum neurotoxin. Nat Commun. Aug. 3, 2017;8:14130. doi: 10.1038/ncomms14130.

[No Author Listed] Genbank Submission. NCBI; Accession No. WP_010869888, version WP_010869888.1. tyrosine—tRNA ligase [*Methanocaldococcus jannaschii*]. Jun. 1, 2019.

Genbank Submission. NCBI; Accession No. WP_011033391, version WP_011033391.1. pyrrolysine—tRNA(Pyl) ligase [*Methanosarcina mazei*]. Polycarpo et al.; Nov. 29, 2019.

Genbank Submission. NCBI; Accession No. WP_011305865, version WP_011305865.1. pyrrolysine—tRNA(Pyl) ligase [*Methanosarcina barkeri*].Polycarpo et al.; Nov. 29, 2019.

Agarwal et al., Mode of VAMP substrate recognition and inhibition of Clostridium botulinum neurotoxin F. Nat Struct Mol Biol. Jul. 2009;16(7):789-94. doi: 10.1038/nsmb.1626. Epub Jun. 21, 2009.

Amiram et al., Evolution of translation machinery in recoded bacteria enables multi-site incorporation of nonstandard amino acids. Nat Biotechnol. Dec. 2015;33(12):1272-1279. doi: 10.1038/nbt.3372. Epub Nov. 16, 2015.

Box et al., A multi-domain protein system based on the HC fragment of tetanus toxin for targeting DNA to neuronal cells. J Drug Target. Jul. 2003;11(6):333-43. doi: 10.1080/10611863100001634667.

Chen et al., SNARE-mediated membrane fusion. Nat Rev Mol Cell Biol. Feb. 2001;2(2):98-106.

Chin, Expanding and reprogramming the genetic code of cells and animals. Annu Rev Biochem. 2014;83:379-408. doi: 10.1146/annurev-biochem-060713-035737. Epub Feb. 10, 2014.

Fan et al., Rationally evolving tRNAPyl for efficient incorporation of noncanonical amino acids. Nucleic Acids Res. Dec. 15, 2015;43(22):e156. doi: 10.1093/nar/gkv800. Epub Aug. 6, 2015.

Guo et al., Evolution of amber suppressor tRNAs for efficient bacterial production of proteins containing nonnatural amino acids. Angew Chem Int Ed Engl. 2009;48(48):9148-51. doi: 10.1002/anie.200904035.

Guo et al., Polyspecific pyrrolysyl-tRNA synthetases from directed evolution. Proc Natl Acad Sci U S A. Nov. 25, 2014;111(47):16724-9. doi: 10.1073/pnas.1419737111. Epub Nov. 10, 2014.

Hedstrom et al., Converting trypsin to chymotrypsin: the role of surface loops. Science. Mar. 1992;255(5049):1249-53.

Herring et al., The amino-terminal domain of pyrrolysyl-tRNA synthetase is dispensable in vitro but required for in vivo activity. FEBS Lett. Jul. 10, 2007;581(17):3197-203. doi: 10.1016/j.febslet.2007.06.004. Epub Jun. 12, 2007.

Jiang et al., PylSn and the homologous N-terminal domain of pyrrolysyl-tRNA synthetase bind the tRNA that is essential for the genetic encoding of pyrrolysine. J Biol Chem. Sep. 21, 2012;287(39):32738-46. doi: 10.1074/jbc.M112.396754. Epub Jul. 31, 2012.

Kavran et al., Structure of pyrrolysyl-tRNA synthetase, an archaeal enzyme for genetic code innovation. Proc Natl Acad Sci U S A. Jul. 3, 2007;104(27):11268-73. doi: 10.1073/pnas.0704769104. Epub Jun. 25, 2007.

Liu et al., Adding new chemistries to the genetic code. Annu Rev Biochem. 2010;79:413-44. doi: 10.1146/annurev.biochem.052308.105824.

Marcet-Palacios et al., Vesicle-associated membrane protein 7 (VAMP-7) is essential for target cell killing in a natural killer cell line. Biochem Biophys Res Commun. Feb. 15, 2008;366(3):617-23. doi: 10.1016/j.bbrc.2007.11.079. Epub Nov. 26, 2007.

Nozawa et al., Pyrrolysyl-tRNA synthetase-tRNA(Pyl) structure reveals the molecular basis of orthogonality. Nature. Feb. 26, 2009;457(7233):1163-7. doi: 10.1038/nature07611. Epub Dec. 31, 2008.

O'Donoghue et al., Upgrading protein synthesis for synthetic biology. Nat Chem Biol. Oct. 2013;9(10):594-8. doi: 10.1038/nchembio.1339.

Rossetto et al., Botulinum neurotoxins: genetic, structural and mechanistic insights. Nat Rev Microbiol. Aug. 2014;12(8):535-49. doi: 10.1038/nrmicro3295. Epub Jun. 30, 2014.

Turner et al., Structural plasticity of an aminoacyl-tRNA synthetase active site. Proc Natl Acad Sci U S A. Apr. 25, 2006;103(17):6483-8. doi: 10.1073/pnas.0601756103. Epub Apr. 17, 2006.

Umehara et al., N-acetyl lysyl-tRNA synthetases evolved by a CcdB-based selection possess N-acetyl lysine specificity in vitro and in vivo. FEBS Lett. Mar. 23, 2012;586(6):729-33. doi: 10.1016/j.febslet.2012.01.029. Epub Jan. 28, 2012.

Yanagisawa et al., Crystallographic studies on multiple conformational states of active-site loops in pyrrolysyl-tRNA synthetase. J Mol Biol. May 2, 2008;378(3):634-52. doi: 10.1016/j.jmb.2008.02.045. Epub Feb. 29, 2008.

Yanagisawa et al., Multistep engineering of pyrrolysyl-tRNA synthetase to genetically encode N(epsilon)-(o-azidobenzyloxycarbonyl) lysine for site-specific protein modification. Chem Biol. Nov. 24, 2008;15(11):1187-97. doi: 10.1016/j.chembiol.2008.10.004.

U.S. Appl. No. 18/178,780, filed Mar. 6, 2023, Liu et al.

Burland et al., Analysis of the *Escherichia coli* genome VI: DNA sequence of the region from 92.8 through 100 minutes. Nucleic Acids Res. Jun. 25, 1995;23(12):2105-19. doi: 10.1093/nar/23.12.2105.

Esvelt et al., A system for the continuous directed evolution of biomolecules. Nature. Apr. 28, 2011;472(7344):499-503. doi: 10.1038/nature09929. Epub Apr. 10, 2011.

Jones et al., Phage-Assisted Continuous Evolution and Selection of Enzymes for Chemical Synthesis. ACS Cent Sci. Sep. 22, 2021;7(9):1581-1590. doi: 10.1021/acscentsci.1c00811. Epub Sep. 13, 2021.

Lee et al., Enhanced production of human full-length immunoglobulin G1 in the periplasm of *Escherichia coli*. Appl Microbiol Biotechnol. Feb. 2014;98(3):1237-46. doi: 10.1007/s00253-013-5390-z. Epub Nov. 26, 2013.

Manta et al., Disulfide Bond Formation in the Periplasm of *Escherichia coli*. EcoSal Plus. Feb. 2019;8(2). doi: 10.1128/ecosalplus.ESP-0012-2018.

Morrison et al., Disulfide-compatible phage-assisted continuous evolution in the periplasmic space. Nat Commun. Oct. 13, 2021;12(1):5959. doi: 10.1038/s41467-021-26279-8.

Popa et al., Phage-Assisted Continuous Evolution (PACE): A Guide Focused on Evolving Protein-DNA Interactions. ACS Omega. Oct. 16, 2020;5(42):26957-26966. doi: 10.1021/acsomega.0c03508. eCollection Oct. 27, 2020.

(56) References Cited

OTHER PUBLICATIONS

U.S. Appl. No. 18/365,105, filed Aug. 3, 2023, Liu et al.
U.S. Appl. No. 18/414,114, filed Jan. 16, 2024, Liu et al.
Chen et al., Multiple pocket recognition of SNAP25 by botulinum neurotoxin serotype E. J Biol Chem. Aug. 31, 2007;282(35):25540-7. doi: 10.1074/jbc.M701922200. Epub Jul. 3, 2007.
Latremoliere et al., Reduction of Neuropathic and Inflammatory Pain through Inhibition of the Tetrahydrobiopterin Pathway. Neuron. Jun. 17, 2015;86(6):1393-406. doi: 10.1016/j.neuron.2015.05.033.

\* cited by examiner

VAMP1: 29-TSNRRLQQTQAQVEEVVDIIRVNVDKVLERDQ/KLSEIDDRADALQAGASQ*FESSAAKLKR-88

VAMP7: 77-KGLDKVMETQAQVDELKGMVRNIDVAQRGE/RIEILLDKTENLVDSSVT*FKTTSRNLAR-139

FIG. 4A

| | |
|---|---|
| T7-PAP(TEV): | (T7-lys)/SGGGGASGGGAGENLYFQ/SAGGSAGGSAGG (T7 RNAP) |
| T7-PAP(VAMP1): | (T7-lys)/TSNRRLQQTQAQVEEVVDIIRVNVDKVLERDQ/KLSEIDDRADALQAGASQFESSAAKLKR (T7 RNAP) |
| T7-PAP(VAMP2): | (T7-lys)/TSNRRLQQTQAQVEEVVDIMRVNVDKVLERDQ/KLSEIDDRADALQAGASQFEISAAKLKR (T7 RNAP) |
| T7-PAP(VAMP1.1): | (T7-lys)/TSNRRLQQTQAQVEEVVDIIRVNVDKVLERGQ/KLSEIDDRADALQAGASQFESSAAKLKR (T7 RNAP) |
| T7-PAP(VAMP1.2): | (T7-lys)/TSNRRLQQTQAQVEEVVDIIRVNVDKVAERGQ/KLSEIDDRADALQAGASQFESSAAKLKR (T7 RNAP) |
| T7-PAP(VAMP1.3): | (T7-lys)/TSNRRLQQTQAQVEEVVDIIRVNVDKVAERGE/KLSEIDDRADALQAGASQFESSAAKLKR (T7 RNAP) |
| T7-PAP(VAMP1.4): | (T7-lys)/KGLDKVQQTQAQVEEVVDIIRVNVDKVAERGE/KLSEIDDRTENLVDSSVTFKTTSRNLAR (T7 RNAP) |
| T7-PAP(VAMP1.5): | (T7-lys)/KGLDKVQQTQAQVEEVVDIIRVNVDKVAERGE/KLSEIDDRTENLVDSSVTFKTTSRNLAR (T7 RNAP) |

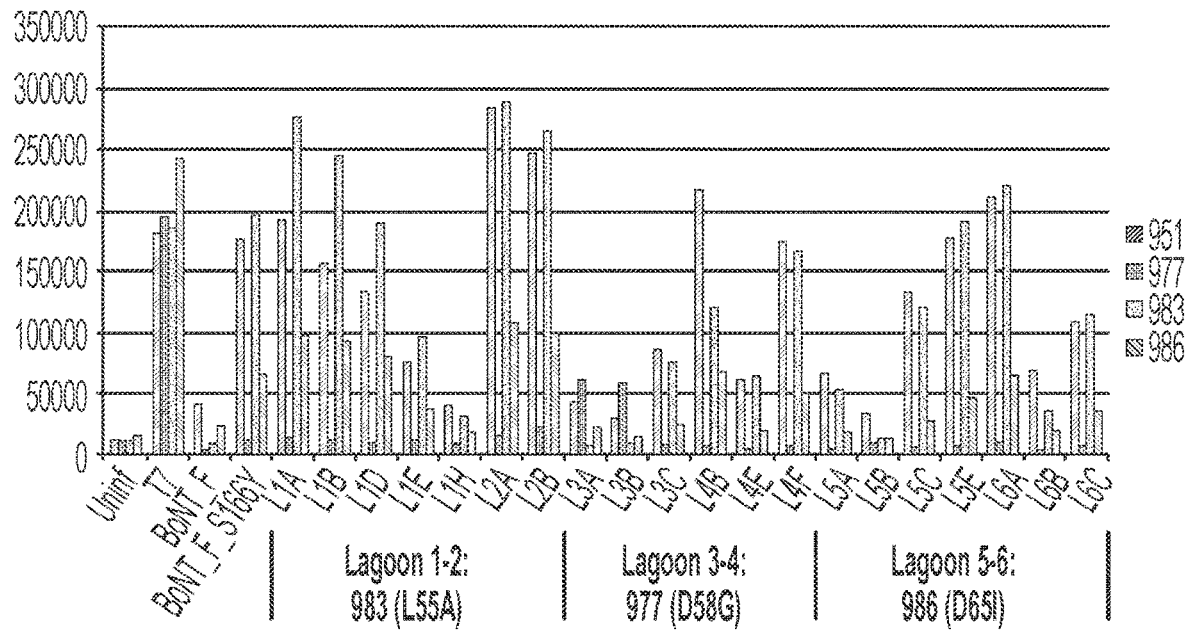
FIG. 15
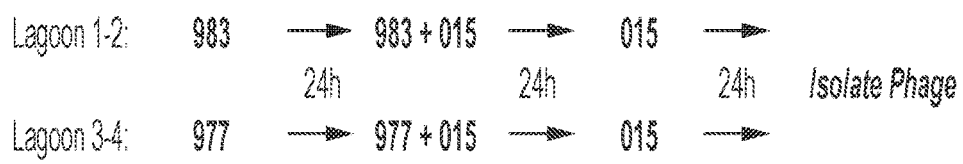
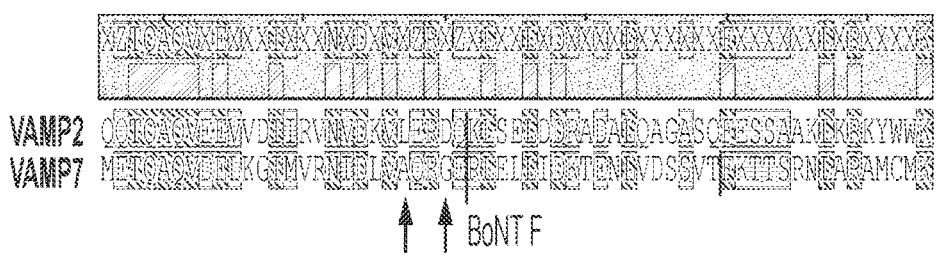
FIG. 16

| Stepping-stone | Strategy | | | | | | | | | | | | | | | | | | | |
|---|---|---|---|---|---|---|---|---|---|---|---|---|---|---|---|---|---|---|---|---|
| 0 | | M | G | N | E | I | D | T | Q | N | R | Q | | D | R | | M | E | K | A | D |
| 1 | NNK 216, 225 | M | G | N | E | I | D | T | Q | N | R | Q | | G | R | | M | E | K | A | D |
| 2 | Direct propagation | M | G | N | E | I | D | T | Q | N | R | Q | | G | S | | M | E | K | A | D |
| 3 | Direct propagation | M | G | S | | C | D | T | Q | N | R | Q | | G | S | | M | E | K | A | D |
| 4 | Mixing | N | G | S | | C | D | Q | E | | D | S | | G | S | | M | E | K | A | D |
| 5 | Mixing | N | G | S | | C | D | Q | E | | D | S | | G | S | | E | R | A | D | N |

L2

| Stepping-stone | Strategy | | | | | | | | | | | | | | | | | | | |
|---|---|---|---|---|---|---|---|---|---|---|---|---|---|---|---|---|---|---|---|---|
| 0 | | M | G | N | E | I | D | T | Q | N | R | Q | | D | R | | M | E | K | A | D |
| 1 | NNK 159, 161 | M | G | N | E | I | D | T | Q | N | R | Q | | D | S | | M | E | K | A | D |
| 2 | Direct propagation | M | G | N | E | I | D | T | Q | N | R | Q | | G | S | | M | E | K | A | D |
| 3 | Direct propagation | M | G | S | | C | D | T | Q | N | R | Q | | G | S | | M | E | K | A | D |
| 4 | Mixing | N | G | S | | C | D | Q | E | | D | S | | G | S | | M | E | K | A | D |
| 5 | Mixing | N | G | S | | C | D | Q | E | | D | S | | G | S | | E | R | A | D | N |

L3

| Stepping-stone | Strategy | | | | | | | | | | | | | | | | | | | |
|---|---|---|---|---|---|---|---|---|---|---|---|---|---|---|---|---|---|---|---|---|
| 0 | | M | G | N | E | I | D | T | Q | N | R | Q | | D | R | | M | E | K | A | D |
| 1 | NNK 216, 225 | M | G | N | E | I | D | T | Q | N | R | Q | | G | R | | M | E | K | A | D |
| 2 | NNK 159, 161 | M | G | N | E | I | D | T | Q | N | R | Q | | G | S | | M | E | K | A | D |
| 3 | Direct propagation | M | G | S | | C | D | T | Q | N | R | Q | | G | S | | M | E | K | A | D |
| 4 | Mixing | N | G | S | | C | D | Q | E | | D | S | | G | S | | M | E | K | A | D |
| 5 | Mixing | N | G | S | | C | D | Q | E | | D | S | | G | S | | E | R | A | D | N |

L4

| Stepping-stone | Strategy | | | | | | | | | | | | | | | | | | | |
|---|---|---|---|---|---|---|---|---|---|---|---|---|---|---|---|---|---|---|---|---|
| 0 | | M | G | N | E | I | D | T | Q | N | R | Q | | D | R | | M | E | K | A | D |
| 1 | NNK 159, 161 | M | G | N | E | I | D | T | Q | N | R | Q | | D | S | | M | E | K | A | D |
| 2 | NNK 216, 225 | M | G | N | E | I | D | T | Q | N | R | Q | | G | S | | M | E | K | A | D |
| 3 | Direct propagation | M | G | S | | C | D | T | Q | N | R | Q | | G | S | | M | E | K | A | D |
| 4 | Mixing | N | G | S | | C | D | Q | E | | D | S | | G | S | | M | E | K | A | D |
| 5 | Mixing | N | G | S | | C | D | Q | E | | D | S | | G | S | | E | R | A | D | N |

| | 167 | 168 | 169 | 170 | 171 | 172 | 173 | 174 | 175 | 176 | 177 | 178 | 179 | 180 | 181 | 182 | 183 | 184 | 185 | 186 |
|---|---|---|---|---|---|---|---|---|---|---|---|---|---|---|---|---|---|---|---|---|
| SNAP25 | M | G | N | E | I | D | T | Q | N | R | Q | | D | R | | M | E | K | A | D |
| SNAP23 | I | G | N | E | | D | A | Q | N | P | Q | | K | R | | T | D | K | A | D |
| PTEN | N | G | S | L | C | D | Q | E | I | D | S | | C | S | I | E | R | A | D | N |

EVOLUTION OF BoNT PEPTIDASES

RELATED APPLICATIONS

This application claims the benefit under 35 U.S.C. 119(e) of the filing date of U.S. Provisional Application Ser. No. 62/550,408, filed Aug. 25, 2017, entitled "EVOLUTION OF BONT PEPTIDASES", the entire contents of which are incorporated herein by reference.

FEDERALLY SPONSORED RESEARCH

This application is a national stage filing under 35 U.S.C. § 371 of international PCT application, PCT/US2018/048134, filed Aug. 27, 2018, which claims the benefit under 35 U.S.C. § 119(e) of the filing date of U.S. Provisional Application Ser. No. 62/550,408, filed Aug. 25, 2017, entitled "EVOLUTION OF BONT PEPTIDASES", each of which is incorporated herein by reference.

BACKGROUND

Over the last few decades, the medical community has witnessed a remarkable shift in the composition of pharmaceutical therapies from traditional small molecules to biomacromolecules. The growing number of macromolecular therapeutics is a result of their potential for highly specific interactions in biological systems and has been facilitated by improvements in molecular biology and biomolecule engineering. Despite their tremendous success, macromolecular therapies have been limited almost exclusively to extracellular targets due to the significant challenge of their controllable delivery into the cytoplasm. While a number of notable advances have been made in the area of macromolecular delivery, this critical problem remains a major barrier to the development and use of macromolecular therapeutics that address intracellular targets. As an alternative, several natural protein systems are capable of cytoplasmic self-delivery. However, the ability to reengineer these systems to imbue them with the necessary binding or catalytic activities and specificities for therapeutic effect is largely underexplored.

SUMMARY

The disclosure relates to novel Botulinum neurotoxin (BoNT) protease variants and methods of evolving the same. As described herein, BoNT proteases are attractive candidates for continuous evolution because BoNTs provide a built-in cytosolic delivery mechanism, which allows BoNTs to cleave intracellular targets. In some embodiments, evolved BoNT protease variants that cleave a desired substrate (e.g., a disease-associated intracellular protein) are described herein. The disclosure is based, in part, on the discovery that BoNT protease variants that cleave target proteins lacking canonical BoNT cleavage substrates can be produced by phage-assisted continuous evolution (PACE), for example as described in U.S. Pat. No. 9,023,594, issued May 5, 2015, the entire contents of which are incorporated herein by reference.

In some embodiments, evolved BoNT protease variants as described herein may be expressed as a part of a full-length toxin comprising of a BoNT light chain (LC) and a BoNT heavy chain (HC). Typically, the catalytic protease domain is located in the light chain (LC) of the BoNT. The BoNT HC encodes domains which generally enable the BoNT protease variant to cross cellular membranes and cleave target proteins in the intracellular environment, making them useful for treating diseases associated with aberrant activity of intracellular proteins (e.g., cancer, neurological disorders, etc.), such as Soluble NSF Attachment Protein Receptors (SNARE) proteins (e.g., VAMP7, VAMP8, etc.). It should be appreciated that evolved BoNT protease variants described herein may comprise an evolved BoNT LC, or both an evolved BoNT LC and HC. In some embodiments, an evolved BoNT protease variant comprises a wild-type BoNT HC. In some embodiments, an evolved BoNT protease variant comprises a BoNT HC having one or more amino acid mutations relative to a wild-type BoNT HC. In some embodiments, the receptor-binding domain of the BoNT HC has been replaced by a protein domain capable of binding to a cell surface receptor or ligand. In some embodiments, this protein domain may take the form of an antibody, lectin, monobody, single-chain variable fragment (scFv), hormone or signaling factor.

Accordingly, in some aspects, the disclosure provides a protein that is evolved from a wild-type Botulinum neurotoxin serotype E (e.g., an evolved BoNT E protease variant, also referred to as a "BoNT E variant") to cleave a non-canonical BoNT E substrate, for example SNAP23 or PTEN, or evolved to cleave the canonical BoNT E substrate SNAP25 with higher efficiency than wild-type BoNT E. In some embodiments, wild-type BoNT E comprises the sequence set forth in SEQ ID NO: 286

```
MPKINSFNYNDPVNDRTILYIKPGGCQEFYKSFNIMKNIWIIPERNVIGT

TPQDFHPPTSLKNGDSSYYDPNYLQSDEEKDRFLKIVTKIFNRINNNLSG

GILLEELSKANPYLGNDNTPDNQFHIGDASAVEIKFSNGSQHILLPNVII

MGAEPDLFETNSSNISLRNNYMPSNHGFGSIAIVTFSPEYSFRFNDNSIN

EFIQDPALTLMHELIHSLHGLYGAKGITTTCIITQQQNPLITNRKGINIE

EFLTFGGNDLNIITVAQYNDIYTNLLNDYRKIASKLSKVQVSNPQLNPYK

DIFQEKYGLDKDASGIYSVNINKFDDILKKLYSFTEFDLATKFQVKCRET

YIGQYKYFKLSNLLNDSIYNISEGYNINNLKVNFRGQNANLNPRIIKPIT

GRGLVKKIIRF*.
```

In some aspects, the disclosure provides a protein comprising an amino acid sequence that is at least 96% identical to SEQ ID NO: 286 (wild-type BoNT E), wherein the protein comprises at least one of the amino acid mutations set forth in Table 1.

In some aspects, the disclosure provides a protein that is evolved from a wild-type Botulinum neurotoxin serotype F (e.g., an evolved BoNT F protease variant, also referred to as a "BoNT F variant") to cleave a non-canonical BoNT F substrate, for example VAMP7, or evolved to cleave a canonical BoNT F substrate (e.g., VAMP1) with higher efficiency than wild-type BoNT F. In some embodiments, wild-type BoNT F comprises the sequence set forth in SEQ ID NO: 287

```
MPVVINSFNYNDPVNDDTILYMQIPYEEKSKKYYKAFEIMRNVWIIPERN

TIGTDPSDFDPPASLENGSSAYYDPNYLTTDAEKDRYLKTTIKLFKRINS

NPAGEVLLQEISYAKPYLGNEHTPINEFHPVTRTTSVNIKSSTNVKSSII

LNLLVLGAGPDIFENSSYPVRKLMDSGGVYDPSNDGFGSINIVTFSPEYE
```

-continued

YTFNDISGGYNSSTESFIADPAISLAHELIHALHGLYGARGVTYKETIKV

KQAPLMIAEKPIRLEEFLTFGGQDLNIITSAMKEKIYNNLLANYEKIATR

LSRVNSAPPEYDINEYKDYFQWKYGLDKNADGSYTVNENKFNEIYKKLYS

FTEIDLANKFKVKCRNTYFIKYGFLKVPNLLDDDIYTVSEGFNIGNLAVN

NRGQNIKLNPKIIDSIPDKGLVEKIVKF*.

In some aspects, the disclosure provides a protein comprising an amino acid sequence that is at least 90% (e.g., at least 95%, at least 96%, at least 97%, etc.) identical to SEQ ID NO: 287 (wild-type BoNT F), wherein the protein comprises at least one of the amino acid mutations set forth in Table 2.

In some aspects, the disclosure relates to evolved BoNT protease variants that cleave intracellular vesicle-associated membrane proteins (VAMPs). VAMPs are members of the SNARE protein family and typically mediate vesicle fusion, such as synaptic vesicle fusion and vesicular secretion. Without wishing to be bound by any particular theory, aberrant function of VAMPs is associated with certain diseases, for example motor neuron disease. Thus, evolved BoNT proteases that cleave certain VAMPs, in some embodiments, are useful for reducing VAMP protein activity inside a cell or a subject. In some embodiments, a protein (e.g., a BoNT F variant) cleaves a vesicle-associated membrane (VAMP) protein, for example, a VAMP7 protein or a VAMP8 protein. In some embodiments, the VAMP7 protein comprises a sequence set forth in SEQ ID NO: 288

MAILFAVVARGTTILAKHAWCGGNFLEDFERSRAFNFLNEIKKRFQTTY

GSRAQTALPYAMNSEFSSVLAAQLKHHSENKGLDKVMETQAQVDELKGI

MVRNIDLVAQRGERLELLIDKTENLVDSSVTFKTTSRNLARAMCMKNLK

LTIIIIIVSIVFIYIIVSPLCGGFTWPSCVKK or the VAMP8 protein comprises a sequence set forth in SEQ ID NO: 289

MEEASEGGGNDRVRNLQSEVEGVKNIMTQNVERILARGENLEHLRNKTE

DLEATSEHFKTTSQKVARKFWWKNVKMIVLICVIVFIIILFIVLFATGA

FS.

In some embodiments, a protein (e.g., a BoNT F variant) cleaves a VAMP1 or a VAMP2 protein. In some embodiments, the VAMP1 protein comprises a sequence set forth in SEQ ID NO: 290

MSAPAQPPAEGTEGTAPGGGPPGPPPNMTSNRRLQQTQAQVEEVVDIIR

VNVDKVLERDQKLSELDDRADALQAGASQFESSAAKLKRKYWWKNCKMM

IMLGAICAIIVVVIVRRG, or the VAMP2 protein comprises a sequence set forth in SEQ ID NO: 291

MSATAATAPPAAPAGEGGPPAPPPNLTSNRRLQQTQAQVDEVVDIMRVN

VDKVLERDQKLSELDDRADALQAGASQFETSAAKLKRKYWWKNLKMMII

LGVICAIILIIIIVYFST.

In some embodiments, a protein (e.g., a BoNT E variant) cleaves a SNAP25 protein. In some embodiments, the SNAP25 protein comprises a sequence set forth in SEQ ID NO: 292

MAEDADMRNELEEMQRRADQLADESLESTRRMLQLVEESKDAGIRTLVM

LDEQGEQLERIEEGMDQINKDMKEAEKNLTDLGKFCGLCVCPCNKLKSS

DAYKKAWGNNQDGVVASQPARVVDEREQMAISGGFIRRVTNDARENEMD

ENLEQVSGIIGNLRHMALDMGNEIDTQNRQIDRIMEKADSNKTRIDEAN

QRATKMLGSG.

In some embodiments, a protein (e.g., a BoNT E variant) cleaves a SNAP23 protein. In some embodiments, the SNAP23 protein comprises a sequence set forth in SEQ ID NO: 293

MDNLSSEEIQQRAHQITDESLESTRRILGLAIESQDAGIKTITMLDEQK

EQLNRIEEGLDQINKDMRETEKTLTELNKCCGLCVCPCNRTKNFESGKA

YKTTWGDGGENSPCNVVSKQPGPVTNGQLQQPTTGAASGGYIKRITNDA

REDEMEENLTQVGSILGNLKDMALNIGNEIDAQNPQIKRITDKADTNRD

RIDIANARAKKLIDS.

In some embodiments, a protein (e.g., a BoNT E variant) cleaves a Phosphatase and tensin homolog (PTEN) protein. In some embodiments, the PTEN protein comprises a sequence set forth in SEQ ID NO: 294

MTAIIKEIVSRNKRRYQEDGFDLDLTYIYPNIIAMGFPAERLEGVYRNN

IDDVVRFLDSKHKNHYKIYNLCAERHYDTAKFNCRVAQYPFEDHNPPQL

ELIKPFCEDLDQWLSEDDNHVAAIHCKAGKGRTGVMICAYLLHRGKFLK

AQEALDFYGEVRTRDKKGVTIPSQRRYVYYYSYLLKNHLDYRPVALLFH

KMMFETIPMFSGGTCNPQFVVCQLKVKIYSSNSGPTRREDKFMYFEFPQ

PLPVCGDIKVEFFHKQNKMLKKDKMFHFWVNTFFIPGPEETSEKVENGS

LCDQEIDSICSIERADNDKEYLVLTLTKNDLDKANKDKANRYFSPNFKV

KLYFTKTVEEPSNPEASSSTSVTPDVSDNEPDHYRYSDTTDSDPENEPF

DEDQHTQITKV.

In some embodiments, a BoNT E variant protease comprises at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 amino acid mutations set forth in Table 1.

In some embodiments, a BoNT F variant protease comprises at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 amino acid mutations set forth in Table 2.

In some embodiments, at least one of the amino acid sequence mutations of a BoNT E variant is introduced at an amino acid position selected from the group consisting of 118, C26, Q27, E28, F29 Y68, L89, S99, G101, N118, G127, Q141, E154, E159, N161, S162, S163, R168, M172, K225, C231, I232, I233, N238, Q295, Q354, Y357, I396, P398, L404, and I409.

In some embodiments, a BoNT E variant comprises one or more mutations selected from Q27H, S99A, G101S, N118D, E159L, N161Y, S162Q, S163R, M172K, I132T, Q354R, Y357P.

In some embodiments, at least one of the amino acid mutations of a BoNT E variant is selected from the group consisting of 118V, C26Y, Q27H, E28K, F29L, Y68H, L89P, S99A, S99T, G101S, N118D, G127S, Q141K, E154G, E159L, N161Y, S162Q, S163R, R168K, M172K, K225E, C231R, I232T, I233T, N238S, Q295R, I396S, P398L, Q354R, Y357P, L404*, and I409T. In some embodiments, a BoNT E variant (e.g., BoNT L2B from Table 7) comprises the following mutations Q27H, S99A, G101S, N118D, E159L, N161Y, S162Q, S163R, M172K, I132T, Q354R, and Y357P.

In some embodiments, at least one of the amino acid sequence mutations of a BoNT F variant is introduced at an amino acid position selected from the group consisting of S70, N76, V106, E164, S166, S167, N184, V193, Y199, E200, S224, R240, A258, N276, L291, T335, S350, F360, Y372, L375, N396, P410, D418, G420, L421, V422, E423, K424, I425, and V426.

In some embodiments, at least one of the amino acid mutations of a BoNT F variant is selected from the group consisting of S70F, N76D, V106A, E164K, S166Y, S167I, N184K, V193M, Y199H, E200G, E200K, S224I, R240F, R240L, A258S, N276S, N276T, L291M, T335S, S350G, F360L, Y372H, L375R, N396H, P410L, D418Y, G420A, L421W, V422L, E423R, K424, I425S, V426*.

In some embodiments, a BoNT F variant (e.g., BoNT F 2020-L2A; SEQ ID NO.: 390) comprises the following mutations: V106A, S166Y, S167I, E200G, S224I, R240L, S350G, F360L, Y372H, P410L, G420A, L421W, V422L, E423R, I425S, and V426*. In some embodiments, a BoNT F variant (e.g., BoNT F 2020-L3A; SEQ ID NO.: 391) comprises the following mutations: S166Y, N184K, E200G, S224I, R240F, T335S, F360L Y372H, N396H, P410L, D418Y, and E423K.

In some embodiments, at least one of the amino acid mutations of a BoNT F variant is selected from the group consisting of K29, K31, Y72, N99, V106, Y113, V131, S141, I150, V155, S166, S167, M174, G177, G178, N184, V193, E200, Y210, T214, E215, S224, R240, F267, F270, N293, I297, R303, T335, S350, F360, Y372, N396, P410, D418, F420, and E423.

In some embodiments, at least one of the amino acid mutations of a BoNT F variant (e.g., a BoNT F variant described in Table 29) is selected from the group consisting of K29E, K31N, Y72H, N99S, V106A, Y113C, V131G, S141T, I150T, V155I, S166Y, S167I, M174T, G177A, G178A, N184T, V193M, E200G, Y210H, T214I, E215G, S224I, R240L, F267I, F270V, N293D, I297L, R303C, T335S, S350G, F360L, Y372H, N396H, P410L, D418Y, F420S, and E423K.

In some embodiments, a BoNT F variant (e.g., BoNT F 3041-L2D; SEQ ID NO.: 392) comprises the following mutations: K29E, V106A, I150T, S166Y, S167I, M174T, E200G, S224I, R240L, R303C, S350G, F360L, Y372H, N396H, and P410L. In some embodiments, a BoNT F variant (e.g., BoNT 3041-L2F; SEQ ID NO.: 393) comprises the following mutations: Y72H, V106A, V131G, S141T, S166Y, S167I, M174T, E200G, S224I, R240L, S350G, F360L, Y372H, N396H, and P410L.

In some embodiments, at least one of the amino acid mutations of a BoNT F variant is selected from the group consisting of N6, Y10, R49, I52, D58, E60, A63, E66, S70, T90, V106, T123, T132, V145, G159, D161, S166, S167, N184, E200, Y201, N211, F217, S224, A226, A232, R240, I262, L264, D274, N314, G325, D331, S333, T335, N339, S350, F360, T367, F369, Y372, V377, N379, N396, N409, P410, D418, and E423.

In some embodiments, at least one of the amino acid mutations of a BoNT F variant (e.g., a BoNT F variant described in Table 30) is selected from the group consisting of N6S, Y10C, R49L, I52V, D58Y, E60D, A63V, E66K, S70H, T90I, V106A, T123M, T123S, T132I, V145I, G159S, D161G, S166Y, S167I, N184K, E200G, Y201H, N211S, F217L, S224I, A226S, A232T, R240L, I262T, L264M, D274M, N314S, G325S, D331G, S333F, T335I, N339S, S350G, F360L, T367S, F369F, Y372H, V377I, N379H, N396H, N409D, P410L, D418Y, and E423K.

In some embodiments, a BoNT E variant comprises the amino acid sequence as set forth in any one of SEQ ID NOs.: 1-100. In some embodiments, a BoNT F variant comprises the amino acid sequence as set forth in any one of SEQ ID NOs.: 101-285. In some embodiments, a BoNT F variant comprises the amino acid sequence as set forth in any one of SEQ ID NOs.: 390-393.

In some embodiments, an evolved BoNT protease variant comprises a BoNT heavy chain. Generally, a BoNT heavy chain comprises a neurotoxin HCC domain, and a neurotoxin translocation domain (HCN). Without wishing to be bound by any particular theory, the HCC domain binds to specific receptors from the presynaptic terminal of a cell, and the HCN domain translocates the BoNT LC into the cell, resulting in intracellular delivery of the catalytic domain of the protease. In some embodiments, an evolved BoNT protease variant (e.g., a BoNT E variant or a BoNT F variant) further comprises a neurotoxin HCC domain, and/or a neurotoxin translocation domain (HCN), for example, a Botulinum toxin HCC or HCN domain or a Tetanus toxin HCC or HCN domain.

SEQ ID NO: 295
CKSVIPRKGTKAPPRLCIRVNNRELFFVASESSYNENDINTPKEIDDTTN

LNNNYRNNLDEVILDYNSETIPQISNQTLNTLVQDDSYVPRYDSNGTSEI

EEHNVVDLNVFFYLHAQKVPEGETNISLTSSIDTALSEESQVYTFFSSEF

INTINKPVHAALFISWINQVIRDFTTEATQKSTFDKIADISLVVPYVGLA

LNIGNEVQKENFKEAFELLGAGILLEFVPELLIPTILVFTIKSFIGSSEN

KNKIIKAINNSLMERETKWKEIYSWIVSNWLTRINTQFNKRKEQMYQALQ

NQVDAIKTVIEYKYNNYTSDERNRLESEYNINNIREELNKKVSLAMENIE

RFITESSIFYLMKLINEAKVSKLREYDEGVKEYLLDYISEHRSILGNSVQ

ELNDLVTSTLNNSIPFELSSYTNDKILILYF (BoNT F HC$_N$, translocation domain);

SEQ ID NO: 296
NKLYKKIKDNSILDMRYENNKFIDISGYGSNISINGDVYIYSTNRNQFGI

YSSKPSEVNIAQNNDIIYNGRYQNFSISFWVRIPKYFNKVNLNNEYTIID

CIRNNNSGWKISLNYNKIIWTLQDTAGNNQKLVFNYTQMISISDYINKWI

FVTITNNRLGNSRIYINGNLIDEKSISNLGDIHVSDNILFKIVGCNDTRY

VGIRYFKVFDTELGKTEIETLYSDEPDPSILKDFWGNYLLYNKRYYLLNL

LRTDKSITQNSNFLNINQQRGVYQKPNIFSNTRLYTGVEVIIRKNGSTDI

SNTDNFVRKNDLAYINVVDRDVEYRLYADISIAKPEKIIKLIRTSNSNNS

-continued

LGQIIVMDSIGNNCTMNFQNNNGGNIGLLGFHSNNLVASSWYYNNIRKNT

SSNGCFWSFISKEHGWQEN (BoNT F HC$_C$, Binding domain);

SEQ ID NO: 297
CKNIVSVKGIRKSICIEINNGELFFVASENSYNDDNINTPKEIDDTVTSN

NNYENDLDQVILNFNSESAPGLSDEKLNLTIQNDAYIPKYDSNGTSDIEQ

HDVNELNVFFYLDAQKVPEGENNVNLTSSIDTALLEQPKIYTFFSSEFIN

NVNKPVQAALFVSWIQQVLVDFTTEANQKSTVDKIADISIVVPYIGLALN

IGNEAQKGNFKDALELLGAGILLEFEPELLIPTILVFTIKSFLGSSDNKN

KVIKAINNALKERDEKWKEVYSFIVSNWMTKINTQFNKRKEQMYQALQNQ

VNAIKTIIESKYNSYTLEEKNELTNKYDIKQIENELNQKVSIAMNNIDRF

LTESSISYLMKLINEVKINKLREYDENVKTYLLNYIIQHGSILGESQQEL

NSMVTDTLNNSIPFKLSSYTDDKILISYFNKFFKRIKS (BoNT E

HC$_N$, translocation domain);

SEQ ID NO: 298
SSVLNMRYKNDKYVDTSGYDSNININGDVYKYPTNKNQFEIYNDKLSEVN

ISQNDYIIYDNKYKNFSISFWVRIPNYDNKIVNVNNEYTIINCMRDNNSG

WKVSLNHNEIIWTLQDNAGINQKLAFNYGNANGISDYINKWIFVTITNDR

LGDSKLYINGNLIDQKSILNLGNIHVSDNILFKIVNCSYTRYIGIRYFNI

FDKELDETEIQTLYSNEPNTNILKDFWGNYLLYDKEYYLLNVLKPNNFID

RRKDSTLSINNIRSTILLANRLYSGIKVKIQRVNNSSTNDNLVRKNDQVY

INFVASKTHLFPLYADTATTNKEKTIKISSSGNRFNQVVVMNSVGNNCTM

NFKNNNGNNIGLLGFKADTVVASTWYYTHMRDHTNSNGCFWNFISEEHGW

QEK (BoNT E HC$_C$, Binding domain)

In some aspects, the disclosure provides a pharmaceutical composition comprising a protein (e.g., a BoNT E variant or a BoNT F variant) as described herein and a pharmaceutically acceptable excipient.

In some aspects, the disclosure provides an isolated nucleic acid encoding a BoNT E variant or a BoNT F variant comprising an amino acid sequence as set forth in any one of SEQ ID NOs.: 1-285 or 390-393. In some aspects, the isolated nucleic acid is contained in a host cell, for example, a bacterial cell, yeast cell, or mammalian cell (e.g., human cell, mouse cell, etc.).

In some aspects, the disclosure provides a method of cleaving an intracellular protein, the method comprising delivering to a cell a BoNT E variant or a BoNT F variant as described herein, wherein the protein contacts the intracellular protein in the cell. In some embodiments, the cell is in a subject, for example, a mammalian subject, such as a human or mouse.

In some aspects, the disclosure provides a method for reducing VAMP7 activity in a subject, the method comprising administering to the subject an effective amount of a BoNT E variant or a BoNT F variant as described herein. In some embodiments, the subject has or is suspected of having a disease characterized by increased or aberrant VAMP7 activity, for example, cancer, transplantation rejection, or graft-versus-host disease.

In some aspects, the disclosure provides a method for reducing VAMP8 activity in a subject, the method comprising administering to the subject an effective amount of a BoNT E variant or a BoNT F variant as described herein.

In some aspects, the disclosure provides a method for reducing PTEN activity in a subject, the method comprising administering to the subject an effective amount of a BoNT E variant as described herein. In some embodiments, the subject has or is suspected of having a disease characterized by neuro-degeneration and in which inhibition of PTEN activity could transiently induce cellular regeneration, for example, ischemic neuronal injury (stroke), Parkinson's Disease, Huntington's Disease, Alzheimer's Disease, or spinal cord injury.

In some aspects, the disclosure provides a method for reducing SNAP23 activity in a subject, the method comprising administering to the subject an effective amount of a BoNT E variant as described herein. In some embodiments, the subject has or is suspected of having a disease characterized by hypersecretion and in which cleavage of SNAP23 could prevent said secretion, for example, diabetes, autoimmune disorders or Cushing Disease.

In some aspects, the disclosure relates to methods of producing an evolved BoNT E variant or BoNT F variant using phage-assisted continuous evolution (PACE). The general concept of PACE technology been described, for example, in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Application, U.S. Ser. No. 13/922,812, filed Jun. 20, 2013; International PCT Applications, PCT/US2015/057012, filed on Oct. 22, 2015, published as WO 2016/077052; and PCT/US2016/027795, filed on Apr. 15, 2016, published as WO 2016/168631, the entire contents of each of which are incorporated herein by reference. In some embodiments, evolved proteases described herein (e.g., proteases evolved using PACE technology described herein) cleave certain substrates (e.g., VAMP1, VAMP2, VAMP7, VAMPS, SNAP25, SNAP23 or PTEN) with higher efficiency and/or specificity relative to previously described BoNT proteases.

The summary above is meant to illustrate and outline, in a non-limiting manner, some of the embodiments, advantages, features, and uses of the technology disclosed herein. The disclosure is, however, not limited to the embodiments described in the summary above. Other embodiments, advantages, features, and uses of the technology disclosed herein will be apparent from the Detailed Description, the Drawings, the Examples, and the Claims.

BRIEF DESCRIPTION OF DRAWINGS

FIGS. 4A-4D show PACE selection for the evolution of BoNT proteases. FIG. 4A shows an alignment of VAMP1 and VAMP7 protein sequences. Bold residues have been experimentally determined to be important for BoNT F cleavage activity. Underlined residues are fully conserved. FIG. 4B shows representative T7-PAP constructs for incorporation into PACE accessory plasmids (AP's). FIG. 4C shows analysis of relative cleavage activity for a selection of BoNT-expressing phage on VAMP1- and VAMP2-derived T7-PAP constructs in a luciferase reporter assay. FIG. 4D shows evolution of novel activity in BoNT F phage clones through iterative PACE. BoNT F(1.5) indicates a representative phage clone isolated after PACE selection on the T7-PAP(VAMP71.5) AP. From top to bottom, sequences correspond to SEQ ID NOs: 324-333.

FIG. 6A shows BoNT Light Chain (LC) proteolytic activity in SNARE-derived PA-RNAP constructs. FIG. 6B shows comparative data for wild-type BoNT serotypes B and F to PACE evolved clones displaying improved VAMP1 and VAMP2 cleavage activity.

FIG. 13 shows representative data relating to validation of BoNT Light Chain (LC) selection; data indicate that evolution of BoNT F protease on VAMP1 enriches for the S166Y mutation, which confers broadly increased activity.

FIG. 14 shows one example of a stepping-stone evolutionary pathway for production of BoNT F variants that cleave VAMP7.

FIG. 15 shows protease activity assays for BoNT F variants from three different experiments (Lagoons 1-6). Each experiment produced clones that cleave VAMP1 substrates containing a different single site mutation (L55A, D58G, or D65I).

FIG. 16 is a schematic depiction of PACE experiments to evolve BoNT F that cleave double mutant substrates; the amino acid sequence of the double mutant VAMP1 (L55A/D58G) is also shown. From top to bottom, sequences correspond to SEQ ID NOs: 347-349.

FIG. 19 shows protease-dependent luciferase assay data indicating that certain BoNT F variants produced by PACE can cleave the triple mutant VAMP1 substrate (L55A/D58G/Q59E). From top to bottom, sequences correspond to SEQ ID NOs: 350-351

FIG. 22 shows data indicating that iterative selection on progressively more complex VAMP substrates produces several BoNT F variants that cleave VAMP7.

FIG. 29 shows that mutation of the residue at position 179 (e.g., D179K) of SNAP25 abolished protease activity by BoNT E.

FIG. 32 shows a stepping stone schematic for PACE of BoNT E to cleave the therapeutic target phosphatase and tensin homolog (PTEN). From top to bottom, sequences correspond to SEQ ID NOs: 363-389.

FIG. 38A shows a Western blot of evolved BoNT F protease m2020-L2A ("m" indicates a maltose-binding protein tag on the N-terminus of the protein). FIG. 38B shows a Western blot of Ni-NTA (top) purified BoNT F proteases m2020-L2A and m2020-L3A and subsequent Amylose-purification of BoNT F proteases m2020-L2A and m2020-L3A.

FIG. 45 shows data relating to in vitro validation of BoNT F variants m3041-L2D and m3041-L2F. Clone m3041-L2F was observed to have retained catalytic activity in vitro.

FIG. 46 shows data relating to selectivity of evolved BoNT protease variants. Off-target cleavage was observed for BoNT F 2020-L2A samples.

DEFINITIONS

Figure 1:
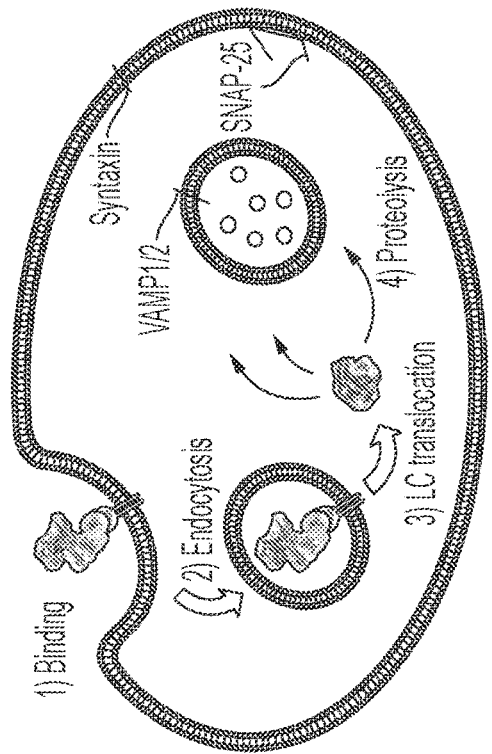
FIG. 1 is a schematic depicting the mechanism of intoxication by Botulinum neurotoxins.
Figure 2:
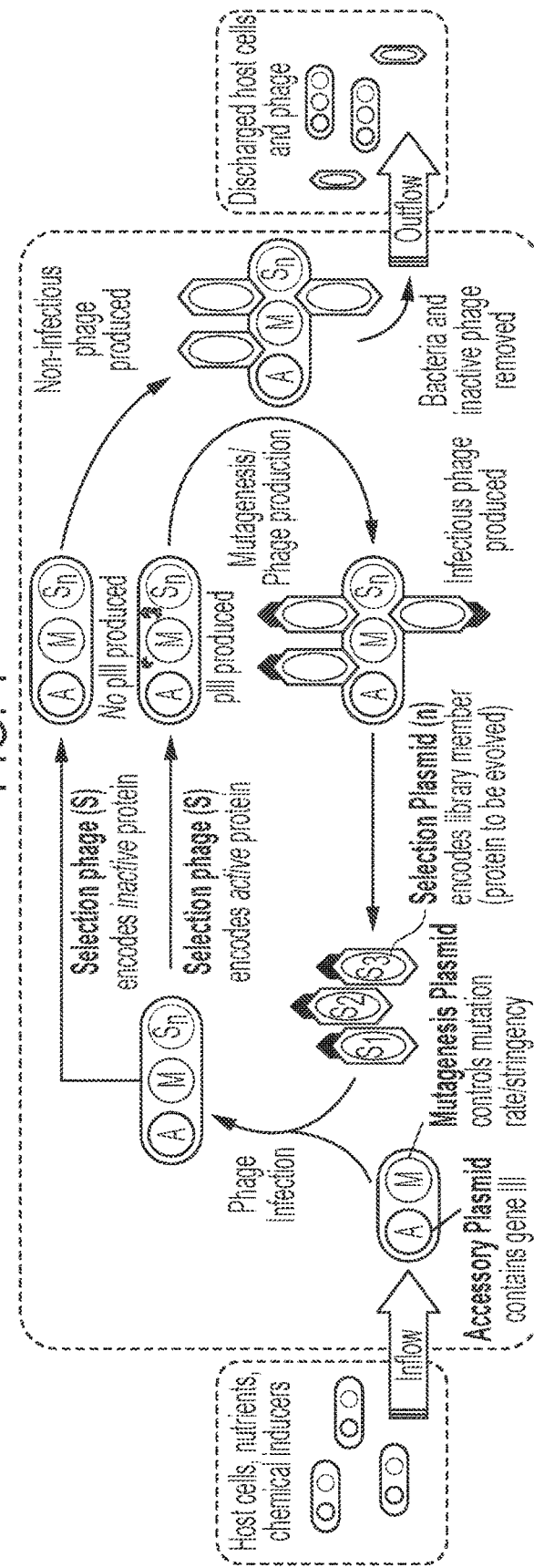
FIG. 2 is a schematic overview of Phage-assisted Continuous Evolution (PACE).
Figure 3:
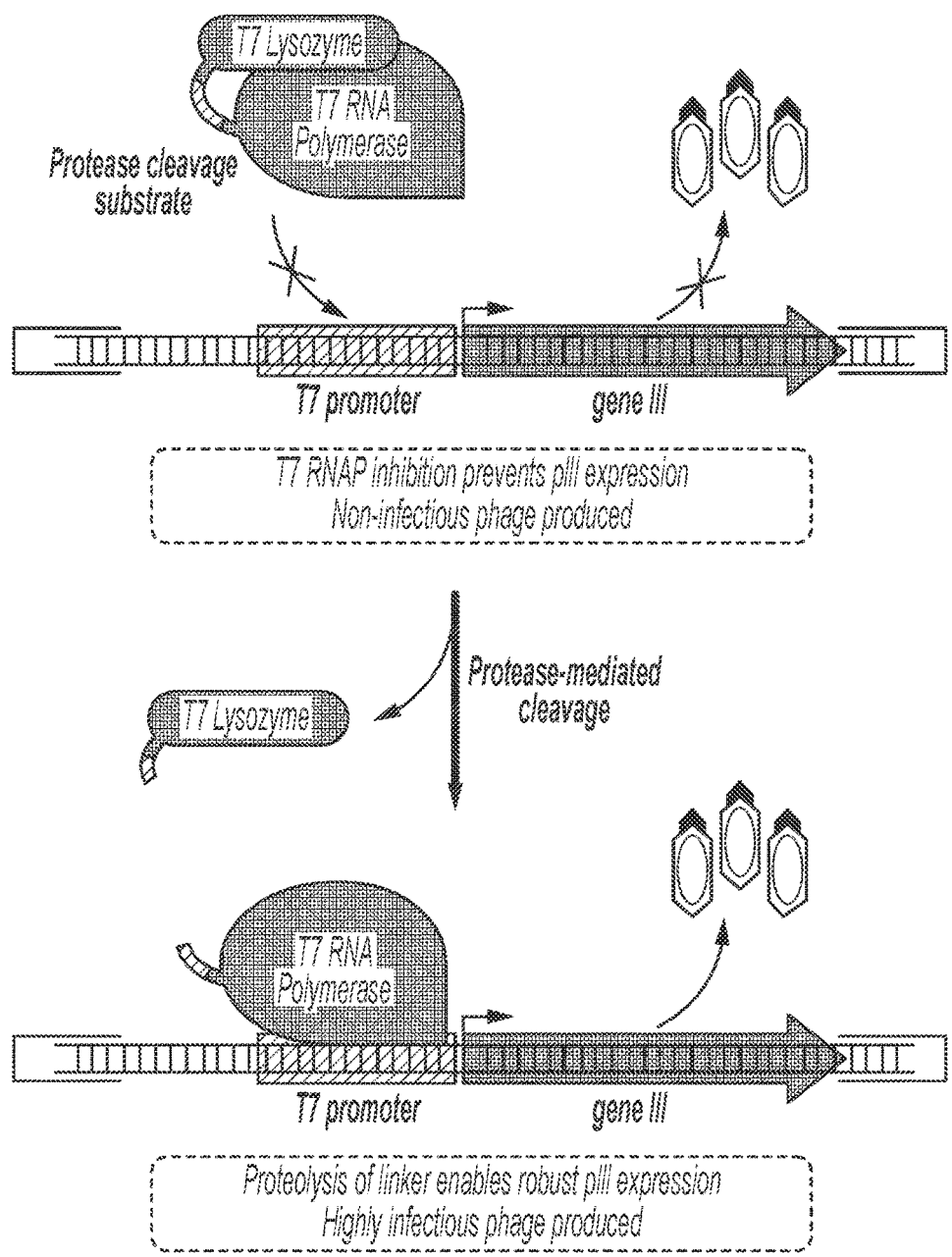
FIG. 3 is a schematic depiction of proteolysis-activated T7 RNA polymerase for PACE selection of proteases.

The term "protease," as used herein, refers to an enzyme that catalyzes the hydrolysis of a peptide (amide) bond linking amino acid residues together within a protein. The term embraces both naturally occurring and engineered proteases. Many proteases are known in the art. Proteases can be classified by their catalytic residue, and protease classes include, without limitation, serine proteases (serine alcohol), threonine proteases (threonine secondary alcohol), cysteine proteases (cysteine thiol), aspartate proteases (aspartate carboxylic acid), glutamic acid proteases (glutamate carboxylic acid), and metalloproteases (metal ion, e.g., zinc). The structures in parentheses correlate to the respective catalytic moiety of the proteases of each class. Some proteases are highly promiscuous and cleave a wide range of protein substrates, e.g., trypsin or pepsin. Other proteases are highly specific and only cleave substrates with a specific sequence. Some blood clotting proteases such as, for example, thrombin, and some viral proteases such as, for example, HCV or TEV protease, are highly specific proteases. In another example, Botulinum toxin proteases (BoNTs) generally cleave specific SNARE proteins. Proteases that cleave in a very specific manner typically bind to multiple amino acid residues of their substrate. Suitable proteases and protease cleavage sites, also sometimes referred to as "protease substrates," will be apparent to those of skill in the art and include, without limitation, proteases listed in the MEROPS database, accessible at merops.sanger.ac.uk and described in Rawlings et al., (2014) MEROPS: the database of proteolytic enzymes, their substrates and inhibitors. *Nucleic Acids Res* 42, D503-D509, the entire contents of each of which are incorporated herein by reference. The disclosure is not limited in this respect.

The term "protein," as used herein, refers to a polymer of amino acid residues linked together by peptide bonds. The term, as used herein, refers to proteins, polypeptides, and peptides of any size, structure, or function. Typically, a protein will be at least three amino acids long. A protein may refer to an individual protein or a collection of proteins. Inventive proteins preferably contain only natural amino acids, although non-natural amino acids (i.e., compounds that do not occur in nature but that can be incorporated into a polypeptide chain; see, for example, cco.caltech.edu/~dadgrp/Unnatstruct.gif, which displays structures of non-natural amino acids that have been successfully incorporated into functional ion channels) and/or amino acid analogs as are known in the art may alternatively be employed. Also, one or more of the amino acids in an inventive protein may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein may also be a single molecule or may be a multi-molecular complex. A protein may be just a fragment of a naturally occurring protein or peptide. A protein may be naturally occurring, recombinant, or synthetic, or any combination of these.

The term "Botulinum neurotoxin (BoNT) protease," as used herein, refers to a protease derived from, or having at least 70% sequence homology to (or at least 70% identity to) a Botulinum neurotoxin (BoNT), for example, a BoNT derived from a bacterium of the genus *Clostridium* (e.g., *C. botulinum*). Structurally, BoNT proteins comprise two conserved domains, a "heavy chain" (HC) and a "light chain" (LC). The LC comprises a zinc metalloprotease domain responsible for the catalytic activity of the protein. The HC typically comprises a HCC domain, which is responsible for binding to neuronal cells, and a HCN domain, which mediates translocation of the protein into a cell. Examples of BoNT HC domains are represented by the amino acid sequences set forth in SEQ ID NO: 299 and 300 below.

BoNT E HCC Domain
SSVLNMRYKNDKYVDTSGYDSNININGDVYKYPTNKNQFEIYNDKLSEVN

ISQNDYIIYDNKYKNFSISFWVRIPNYDNKIVNVNNEYTIINCMRDNNSG

```
                                            -continued
WKVSLNHNEIIWTLQDNAGINQKLAFNYGNANGISDYINKWIFVTITNDR

LGDSKLYINGNLIDQKSILNLGNIHVSDNILFKIVNCSYTRYIGIRYFNI

FDKELDETEIQTLYSNEPNTNILKDFWGNYLLYDKEYYLLNVLKPNNFID

RRKDSTLSINNIRSTILLANRLYSGIKVKIQRVNNSSTNDNLVRKNDQVY

INFVASKTHLFPLYADTATTNKEKTIKISSSGNRFNQVVVMNSVGNNCTM

NFKNNNGNNIGLLGFKADTVVASTWYYTHMRDHTNSNGCFWNFISEEHGW

QEK (BoNT E HC_C, Binding domain)

BoNT E HCN Domain
CKNIVSVKGIRKSICIEINNGELFFVASENSYNDDNINTPKEIDDTVTSN

NNYENDLDQVILNFNSESAPGLSDEKLNLTIQNDAYIPKYDSNGTSDIEQ

HDVNELNVFFYLDAQKVPEGENNVNLTSSIDTALLEQPKIYTFFSSEFIN

NVNKPVQAALFVSWIQQVLVDFTTEANQKSTVDKIADISIVVPYIGLALN

IGNEAQKGNFKDALELLGAGILLEFEPELLIPTILVFTIKSFLGSSDNKN

KVIKAINNALKERDEKWKEVYSFIVSNWMTKINTQFNKRKEQMYQALQNQ

VNAIKTIIESKYNSYTLEEKNELTNKYDIKQIENELNQKVSIAMNNIDRF

LTESSISYLMKLINEVKINKLREYDENVKTYLLNYIIQHGSILGESQQEL

NSMVTDTLNNSIPFKLSSYTDDKILISYFNKFFKRIKS (BoNT E

HC_N, translocation domain)
```

There are seven serotypes of BoNTs, denoted BoNT A-G. BoNT serotypes A, C, and E cleave synaptosome-associated protein (SNAP25). BoNT serotype C has also been observed to cleave syntaxin. BoNT serotypes B, D, F, and G cleave vesicle-associated membrane proteins (VAMPs). An example of a SNAP25 substrate that is cleaved by wild-type BoNT proteases (e.g., BoNT E) is represented by the amino acid sequence set forth in SEQ ID NO: 301. An example of a VAMP substrate (e.g., VAMP1) that is cleaved by wild-type BoNT proteases (e.g., BoNT E) is represented by the amino acid sequence set forth in SEQ ID NO: 302.

```
SNAP25 substrate sequence
MAEDADMRNELEEMQRRADQLADESLESTRRMLQLVEESKDAGIRTLVML

DEQGEQLERIEEGMDQINKDMKEAEKNLTDLGKFCGLCVCPCNKLKSSDA

YKKAWGNNQDGVVASQPARVVDEREQMAISGGFIRRVTNDARENEMDENL

EQVSGIIGNLRHMALDMGNEIDTQNRQIDRIMEKADSNKTRIDEANQRAT

KMLGSG

VAMP1 substrate sequence
MSAPAQPPAEGTEGTAPGGGPPGPPPNMTSNRRLQQTQAQVEEVVDIIRV

NVDKVLERDQKLSELDDRADALQAGASQFESSAAKLKRKYWWKNCKMMIM

LGAICAIIVVVIVRRG
```

A wild-type BoNT protease refers to the amino acid sequence of a BoNT protease as it naturally occurs in a *Clostridium botulinum* genome. Examples of wild-type BoNT proteases are represented by the amino acid sequences set forth in SEQ ID NOs.: 303-309.

```
Botulinum neurotoxin serotype A
MPFVNKQFNYKDPVNGVDIAYIKIPNAGQMQPVKAFKIHNKIWVIPERDT

FTNPEEGDLNPPPEAKQVPVSYYDSTYLSTDNEKDNYLKGVTKLFERIYS

TDLGRMLLTSIVRGIPFWGGSTIDTELKVIDTNCINVIQPDGSYRSEELN

LVIIGPSADIIQFECKSFGHEVLNLTRNGYGSTQYIRFSPDFTFGFEESL

EVDTNPLLGAGKFATDPAVTLAHELIHAGHRLYGIAINPNRVFKVNTNAY

YEMSGLEVSFEELRTFGGHDAKFIDSLQENEFRLYYYNKFKDIASTLNKA

KSIVGTTASLQYMKNVFKEKYLLSEDTSGKFSVDKLKFDKLYKMLTEIYT

EDNFVKFFKVLNRKTYLNFDKAVFKINIVPKVNYTIYDGFNLRNTNLAAN

FNGQNTEINNMNFTKLKNFTGLFEFYKLL

Botulinum neurotoxin serotype B
MPVTINNFNYNDPIDNNNIIMMEPPFARGTGRYYKAFKITDRIWIIPERY

TFGYKPEDFNKSSGIFNRDVCEYYDPDYLNTNDKKNIFLQTMIKLFNRIK

SKPLGEKLLEMIINGIPYLGDRRVPLEEFNTNIASVTVNKLISNPGEVER

KKGIFANLIIFGPGPVLNENETIDIGIQNHFASREGFGGIMQMKFCPEYV

SVFNNVQENKGASIFNRRGYFSDPALILMHELIHVLHGLYGIKVDDLPIV

PNEKKFFMQSTDAIQAEELYTFGGQDPSIITPSTDKSIYDKVLQNFRGIV

DRLNKVLVCISDPNININIYKNKFKDKYKFVEDSEGKYSIDVESFDKLYK

SLMFGFTETNIAENYKIKTRASYFSDSLPPVKIKNLLDNEIYTIEEGFNI

SDKDMEKEYRGQNKAINKQAYEEISKEHLAVYKIQM

Botulinum neurotoxin serotype C
MPITINNFNYSDPVDNKNILYLDTHLNTLANEPEKAFRITGNIWVIPDRF

SRNSNPNLNKPPRVTSPKSGYYDPNYLSTDSDKDTFLKEIIKLFKRINSR

EIGEELIYRLSTDIPFPGNNNTPINTFDFDVDFNSVDVKTRQGNNWVKTG

SINPSVIITGPRENIIDPETSTFKLTNNTFAAQEGFGALSIISISPRFML

TYSNATNDVGEGRFSKSEFCMDPILILMHELNHAMHNLYGIAIPNDQTIS

SVTSNIFYSQYNVKLEYAEIYAFGGPTIDLIPKSARKYFEEKALDYYRSI

AKRLNSITTANPSSFNKYIGEYKQKLIRKYRFVVESSGEVTVNRNKFVEL

YNELTQIFTEFNYAKIYNVQNRKIYLSNVYTPVTANILDDNVYDIQNGFN

IPKSNLNVLFMGQNLSRNPALRKVNPENMLYLFTKF

Botulinum neurotoxin serotype D
MTWPVKDFNYSDPVNDNDILYLRIPQNKLITTPVKAFMITQNIWVIPERF

SSDTNPSLSKPPRPTSKYQSYYDPSYLSTDEQKDTFLKGIIKLFKRINER

DIGKKLINYLVVGSPFMGDSSTPEDTFDPTRHTTNIAVEKFENGSWKVTN

IITPSVLIFGPLPNILDYTASLTLQGQQSNPSFEGFGTLSILKVAPEFLL

TFSDVTSNQSSAVLGKSIFCMDPVIALMHELTHSLHQLYGINIPSDKRIR

PQVSEGFFSQDGPNVQFEELYTFGGLDVEIIPQIERSQLREKALGHYKDI

AKRLNNINKTIPSSWISNIDKYKKIFSEKYNFDKDNTGNFVVNIDKFNSL

YSDLTNVMSEVVYSSQYNVKNRTHYFSRHYLPVFANILDDNIYTIRDGFN

LTNKGFNIENSGQNIERNPALQKLSSESVVDLFTKV

Botulinum neurotoxin serotype E
MTWPVKDFNYSDPVNDNDILYLRIPQNKLITTPVKAFMITQNIWVIPERF

SSDTNPSLSKPPRPTSKYQSYYDPSYLSTDEQKDTFLKGIIKLFKRINER
```

```
-continued
DIGKKLINYLVVGSPFMGDSSTPEDTFDFTRHTTNIAVEKFENGSWKVTN

IITPSVLIFGPLPNILDYTASLTLQGQQSNPSFEGFGTLSILKVAPEFLL

TFSDVTSNQSSAVLGKSIFCMDPVIALMHELTHSLHQLYGINIPSDKRIR

PQVSEGFFSQDGPNVQFEELYTFGGLDVEIIPQIERSQLREKALGHYKDI

AKRLNNINKTIPSSWISNIDKYKKIFSEKYNFDKDNTGNFVVNIDKFNSL

YSDLTNVMSEVVYSSQYNVKNRTHYFSRHYLPVFANILDDNIYTIRDGFN

LTNKGFNIENSGQNIERNPALQKLSSESVVDLFTKV

Botulinum neurotoxin serotype F
MPVVINSFNYNDPVNDDTILYMQIPYEEKSKKYYKAFEIMRNVWIIPERN

TIGTDPSDFDPPASLENGSSAYYDPNYLTTDAEKDRYLKTTIKLFKRINS

NPAGEVLLQEISYAKPYLGNEHTPINEFHPVTRTTSVNIKSSTNVKSSII

LNLLVLGAGPDIFENSSYPVRKLMDSGGVYDPSNDGFGSINIVTFSPEYE

YTFNDISGGYNSSTESFIADPAISLAHELIHALHGLYGARGVTYKETIKV

KQAPLMIAEKPIRLEEFLTFGGQDLNIITSAMKEKIYNNLLANYEKIATR

LSRVNSAPPEYDINEYKDYFQWKYGLDKNADGSYTVNENKFNEIYKKLYS

FTEIDLANKFKVKCRNTYFIKYGFLKVPNLLDDDIYTVSEGFNIGNLAVN

NRGQNIKLNPKIIDSIPDKGLVEKIVKF

Botulinum neurotoxin serotype G
MPVNIKNFNYNDPINNDDIIMMEPFNDPGPGTYYKAFRIIDRIWIVPERF

TYGFQPDQFNASTGVFSKDVYEYYDPTYLKTDAEKDKFLKTMIKLFNRIN

SKPSGQRLLDMIVDAIPYLGNASTPPDKFAANVANVSINKKIIQPGAEDQ

IKGLMTNLIIFGPGPVLSDNFTDSMIMNGHSPISEGFGARMMIRFCPSCL

NVFNNVQENKDTSIFSRRAYFADPALTLMHELIHVLHGLYGIKISNLPIT

PNTKEFFMQHSDPVQAEELYTFGGHDPSVISPSTDMNIYNKALQNFQDIA

NRLNIVSSAQGSGIDISLYKQIYKNKYDFVEDPNGKYSVDKDKFDKLYKA

LMFGFTETNLAGEYGIKTRYSYFSEYLPPIKTEKLLDNTIYTQNEGFNIA

SKNLKTEFNGQNKAVNKEAYEEISLEHLVIYRIAMCKPVMYKNAPPTPG
```

The term "BoNT protease variant," as used herein, refers to a protein (e.g., a BoNT protease) having one or more amino acid variations introduced into the amino acid sequence, e.g., as a result of application of the PACE method or by genetic engineering (e.g., recombinant gene expression, gene synthesis, etc.), as compared to the amino acid sequence of a naturally-occurring or wild-type BoNT protein (e.g., SEQ ID NO: 286 or SEQ ID NO: 287). Amino acid sequence variations may include one or more mutated residues within the amino acid sequence of the protease, e.g., as a result of a change in the nucleotide sequence encoding the protease that results in a change in the codon at any particular position in the coding sequence, the deletion of one or more amino acids (e.g., a truncated protein), the insertion of one or more amino acids, or any combination of the foregoing. In certain embodiments, a BoNT protease variant cleaves a different target peptide (e.g., has broadened or different substrate specificity) relative to a wild-type BoNT protease. For example, in some embodiments, a BoNT F protease variant cleaves a VAMP7 protein or peptide.

The term "continuous evolution," as used herein, refers to an evolution procedure, in which a population of nucleic acids is subjected to multiple rounds of (a) replication, (b) mutation (or modification of the primary sequence of nucleotides of the nucleic acids in the population), and (c) selection to produce a desired evolved product, for example, a novel nucleic acid encoding a novel protein with a desired activity, wherein the multiple rounds of replication, mutation, and selection can be performed without investigator interaction, and wherein the processes (a)-(c) can be carried out simultaneously. Typically, the evolution procedure is carried out in vitro, for example, using cells in culture as host cells. In general, a continuous evolution process provided herein relies on a system in which a gene of interest is provided in a nucleic acid vector that undergoes a life-cycle including replication in a host cell and transfer to another host cell, wherein a critical component of the life-cycle is deactivated and reactivation of the component is dependent upon a desired variation in an amino acid sequence of a protein encoded by the gene of interest.

In some embodiments, the gene of interest (e.g., a gene encoding a BoNT protease) is transferred from cell to cell in a manner dependent on the activity of the gene of interest. In some embodiments, the transfer vector is a virus infecting cells, for example, a bacteriophage or a retroviral vector. In some embodiments, the viral vector is a phage vector infecting bacterial host cells. In some embodiments, the transfer vector is a conjugative plasmid transferred from a donor bacterial cell to a recipient bacterial cell.

In some embodiments, the nucleic acid vector comprising the gene of interest is a phage, a viral vector, or naked DNA (e.g., a mobilization plasmid). In some embodiments, transfer of the gene of interest from cell to cell is via infection, transfection, transduction, conjugation, or uptake of naked DNA, and efficiency of cell-to-cell transfer (e.g., transfer rate) is dependent on an activity of a product encoded by the gene of interest. For example, in some embodiments, the nucleic acid vector is a phage harboring the gene of interest and the efficiency of phage transfer (via infection) is dependent on an activity of the gene of interest in that a protein required for the generation of phage particles (e.g., pIII for M13 phage) is expressed in the host cells only in the presence of the desired activity of the gene of interest.

For example, some embodiments provide a continuous evolution system, in which a population of viral vectors comprising a gene of interest to be evolved replicates in a flow of host cells, e.g., a flow through a lagoon, wherein the viral vectors are deficient in a gene encoding a protein that is essential for the generation of infectious viral particles, and wherein that gene is in the host cell under the control of a conditional promoter that can be activated by a gene product encoded by the gene of interest, or a mutated version thereof. In some embodiments, the activity of the conditional promoter depends on a desired function of a gene product encoded by the gene of interest. Viral vectors, in which the gene of interest has not acquired a desired function as a result of a variation of amino acids introduced into the gene product protein sequence, will not activate the conditional promoter, or may only achieve minimal activation, while any mutations introduced into the gene of interest that confers the desired function will result in activation of the conditional promoter. Since the conditional promoter controls an essential protein for the viral life cycle, e.g., pIII, activation of this promoter directly corresponds to an advantage in viral spread and replication for those vectors that have acquired an advantageous mutation.

The term "flow," as used herein in the context of host cells, refers to a stream of host cells, wherein fresh host cells are being introduced into a host cell population, for example, a host cell population in a lagoon, remain within the population for a limited time, and are then removed from the host cell population. In a simple form, a host cell flow may be a flow through a tube, or a channel, for example, at a controlled rate. In other embodiments, a flow of host cells is directed through a lagoon that holds a volume of cell culture media and comprises an inflow and an outflow. The introduction of fresh host cells may be continuous or intermittent and removal may be passive, e.g., by overflow, or active, e.g., by active siphoning or pumping. Removal further may be random, for example, if a stirred suspension culture of host cells is provided, removed liquid culture media will contain freshly introduced host cells as well as cells that have been a member of the host cell population within the lagoon for some time. Even though, in theory, a cell could escape removal from the lagoon indefinitely, the average host cell will remain only for a limited period of time within the lagoon, which is determined mainly by the flow rate of the culture media (and suspended cells) through the lagoon.

Since the viral vectors replicate in a flow of host cells, in which fresh, uninfected host cells are provided while infected cells are removed, multiple consecutive viral life cycles can occur without investigator interaction, which allows for the accumulation of multiple advantageous mutations in a single evolution experiment.

The term "phage-assisted continuous evolution (PACE)," as used herein, refers to continuous evolution that employs phage as viral vectors.

The term "viral vector," as used herein, refers to a nucleic acid comprising a viral genome that, when introduced into a suitable host cell, can be replicated and packaged into viral particles able to transfer the viral genome into another host cell. The term viral vector extends to vectors comprising truncated or partial viral genomes. For example, in some embodiments, a viral vector is provided that lacks a gene encoding a protein essential for the generation of infectious viral particles. In suitable host cells, for example, host cells comprising the lacking gene under the control of a conditional promoter, however, such truncated viral vectors can replicate and generate viral particles able to transfer the truncated viral genome into another host cell. In some embodiments, the viral vector is a phage, for example, a filamentous phage (e.g., an M13 phage). In some embodiments, a viral vector, for example, a phage vector, is provided that comprises a gene of interest to be evolved.

The term "nucleic acid," as used herein, refers to a polymer of nucleotides. The polymer may include natural nucleosides (i.e., adenosine, thymidine, guano sine, cytidine, uridine, deoxyadenosine, deoxythymidine, deoxyguanosine, and deoxycytidine), nucleoside analogs (e.g., 2-aminoadenosine, 2-thiothymidine, inosine, pyrrolo-pyrimidine, 3-methyl adenosine, 5-methylcytidine, C5-bromouridine, C5-fluorouridine, C5-iodouridine, C5-propynyl-uridine, C5-propynyl-cytidine, C5-methylcytidine, 7-deazaadenosine, 7-deazaguanosine, 8-oxoadenosine, 8-oxoguanosine, O(6)-methylguanine, 4-acetylcytidine, 5-(carboxyhydroxymethyl)uridine, dihydrouridine, methylpseudouridine, 1-methyl adenosine, 1-methyl guanosine, N6-methyl adenosine, and 2-thiocytidine), chemically modified bases, biologically modified bases (e.g., methylated bases), intercalated bases, modified sugars (e.g., 2'-fluororibose, ribose, 2'-deoxyribose, 2'-O-methylcytidine, arabinose, and hexose), or modified phosphate groups (e.g., phosphorothioates and 5'-N-phosphoramidite linkages).

The term "gene of interest" or "gene encoding a protease of interest," as used herein, refers to a nucleic acid construct comprising a nucleotide sequence encoding a gene product, e.g., a BoNT protease, of interest to be evolved in a continuous evolution process as described herein. The term includes any variations of a gene of interest that are the result of a continuous evolution process according to methods described herein. For example, in some embodiments, a gene of interest is a nucleic acid construct comprising a nucleotide sequence encoding a protease to be evolved, cloned into a viral vector, for example, a phage genome, so that the expression of the encoding sequence is under the control of one or more promoters in the viral genome. In other embodiments, a gene of interest is a nucleic acid construct comprising a nucleotide sequence encoding a protease to be evolved and a promoter operably linked to the encoding sequence. When cloned into a viral vector, for example, a phage genome, the expression of the encoding sequence of such genes of interest is under the control of the heterologous promoter and, in some embodiments, may also be influenced by one or more promoters in the viral genome.

The term "function of a gene of interest," as interchangeably used with the term "activity of a gene of interest," refers to a function or activity of a gene product, for example, a nucleic acid or a protein, encoded by the gene of interest. For example, a function of a gene of interest may be an enzymatic activity (e.g., proteolytic activity resulting in the generation of cleavage of a desired substrate, etc.), an ability to activate transcription (e.g., transcriptional activation activity targeted to a specific promoter sequence), a bond-forming activity (e.g., an enzymatic activity resulting in the formation of a covalent bond), or a binding activity (e.g., a protein, DNA, or RNA binding activity).

The term "promoter" refers to a nucleic acid molecule with a sequence recognized by the cellular transcription machinery and able to initiate transcription of a downstream gene. A promoter can be constitutively active, meaning that the promoter is always active in a given cellular context, or conditionally active, meaning that the promoter is only active under specific conditions. For example, a conditional promoter may only be active in the presence of a specific protein that connects a protein associated with a regulatory element in the promoter to the basic transcriptional machinery, or only in the absence of an inhibitory molecule. A subclass of conditionally active promoters are inducible promoters that require the presence of a small molecule "inducer" for activity. Examples of inducible promoters include, but are not limited to, arabinose-inducible promoters, Tet-on promoters, and tamoxifen-inducible promoters. A variety of constitutive, conditional, and inducible promoters are well known to the skilled artisan, and the skilled artisan will be able to ascertain a variety of such promoters useful in carrying out the instant invention, which is not limited in this respect.

The term "viral particle," as used herein, refers to a viral genome, for example, a DNA or RNA genome, that is associated with a coat of a viral protein or proteins, and, in some cases, with an envelope of lipids. For example, a phage particle comprises a phage genome packaged into a protein encoded by the wild type phage genome.

The term "infectious viral particle," as used herein, refers to a viral particle able to transport the viral genome it comprises into a suitable host cell. Not all viral particles are able to transfer the viral genome to a suitable host cell. Particles unable to accomplish this are referred to as non-infectious viral particles. In some embodiments, a viral particle comprises a plurality of different coat proteins, wherein one or some of the coat proteins can be omitted without compromising the structure of the viral particle. In some embodiments, a viral particle is provided in which at least one coat protein cannot be omitted without the loss of infectivity. If a viral particle lacks a protein that confers infectivity, the viral particle is not infectious. For example, an M13 phage particle that comprises a phage genome packaged in a coat of phage proteins (e.g., pVIII) but lacks pIII (protein III) is a non-infectious M13 phage particle because pIII is essential for the infectious properties of M13 phage particles.

The term "viral life cycle," as used herein, refers to the viral reproduction cycle comprising insertion of the viral genome into a host cell, replication of the viral genome in the host cell, and packaging of a replication product of the viral genome into a viral particle by the host cell.

In some embodiments, the viral vector provided is a phage. The term "phage," as used herein interchangeably with the term "bacteriophage," refers to a virus that infects bacterial cells. Typically, phages consist of an outer protein capsid enclosing genetic material. The genetic material can be ssRNA, dsRNA, ssDNA, or dsDNA, in either linear or circular form. Phages and phage vectors are well known to those of skill in the art and non-limiting examples of phages that are useful for carrying out the methods provided herein are λ (Lysogen), T2, T4, T7, T12, R17, M13, MS2, G4, P1, P2, P4, Phi X174, N4, Φ6, and Φ29. In certain embodiments, the phage utilized in the present invention is M13. Additional suitable phages and host cells will be apparent to those of skill in the art, and the invention is not limited in this aspect. For an exemplary description of additional suitable phages and host cells, see Elizabeth Kutter and Alexander Sulakvelidze: *Bacteriophages: Biology and Applications*. CRC Press; 1$^{st}$ edition (December 2004), ISBN: 0849313368; Martha R. J. Clokie and Andrew M. Kropinski: *Bacteriophages: Methods and Protocols, Volume 1: Isolation, Characterization, and Interactions* (*Methods in Molecular Biology*) Humana Press; 1$^{st}$ edition (December, 2008), ISBN: 1588296822; Martha R. J. Clokie and Andrew M. Kropinski: *Bacteriophages: Methods and Protocols, Volume 2: Molecular and Applied Aspects* (*Methods in Molecular Biology*) Humana Press; 1$^{st}$ edition (December 2008), ISBN: 1603275649; all of which are incorporated herein in their entirety by reference for disclosure of suitable phages and host cells as well as methods and protocols for isolation, culture, and manipulation of such phages).

In some embodiments, the phage is a filamentous phage. In some embodiments, the phage is an M13 phage. M13 phages are well known to those in the art and the biology of M13 phages has extensively been studied. Wild type M13 phage particles comprise a circular, single-stranded genome of approximately 6.4 kb. In certain embodiments, the wild-type genome of an M13 phage includes eleven genes, gI-gXI, which, in turn, encode the eleven M13 proteins, pI-pXI, respectively. gVIII encodes pVIII, also often referred to as the major structural protein of the phage particles, while gIII encodes pIII, also referred to as the minor coat protein, which is required for infectivity of M13 phage particles.

The M13 life cycle includes attachment of the phage to the sex pilus of a suitable bacterial host cell via the pIII protein and insertion of the phage genome into the host cell. The circular, single-stranded phage genome is then converted to a circular, double-stranded DNA, also termed the replicative form (RF), from which phage gene transcription is initiated. The wild type M13 genome comprises nine promoters and two transcriptional terminators as well as an origin of replication. This series of promoters provides a gradient of transcription such that the genes nearest the two transcriptional terminators (gVIII and IV) are transcribed at the highest levels. In wild-type M13 phage, transcription of all 11 genes proceeds in the same direction. One of the phage-encoded proteins, pII, initiates the generation of linear, single-stranded phage genomes in the host cells, which are subsequently circularized, and bound and stabilized by pV. The circularized, single-stranded M13 genomes are then bound by pVIII, while pV is stripped off the genome, which initiates the packaging process. At the end of the packaging process, multiple copies of pIII are attached to wild-type M13 particles, thus generating infectious phage ready to infect another host cell and concluding the life cycle.

The M13 phage genome can be manipulated, for example, by deleting one or more of the wild type genes, and/or inserting a heterologous nucleic acid construct into the genome. M13 does not have stringent genome size restrictions, and insertions of up to 42 kb have been reported. This allows M13 phage vectors to be used in continuous evolution experiments to evolve genes of interest without imposing a limitation on the length of the gene to be involved.

The term "selection phage," as used herein interchangeably with the term "selection plasmid," refers to a modified phage that comprises a gene of interest to be evolved and lacks a full-length gene encoding a protein required for the generation of infectious phage particles. For example, some M13 selection phages provided herein comprise a nucleic acid sequence encoding a protease to be evolved, e.g., under the control of an M13 promoter, and lack all or part of a phage gene encoding a protein required for the generation of infectious phage particles, e.g., gI, gII, gIII, gIV, gV, gVI, gVII, gVIII, gIX, or gX, or any combination thereof. For example, some M13 selection phages provided herein comprise a nucleic acid sequence encoding a protease to be evolved, e.g., under the control of an M13 promoter, and lack all or part of a gene encoding a protein required for the generation of infective phage particles, e.g., the gIII gene encoding the pIII protein.

The term "helper phage," as used herein interchangeable with the terms "helper phagemid" and "helper plasmid," refers to a nucleic acid construct comprising a phage gene required for the phage life cycle, or a plurality of such genes, but lacking a structural element required for genome packaging into a phage particle. For example, a helper phage may provide a wild-type phage genome lacking a phage origin of replication. In some embodiments, a helper phage is provided that comprises a gene required for the generation of phage particles, but lacks a gene required for the generation of infectious particles, for example, a full-length pIII gene. In some embodiments, the helper phage provides only some, but not all, genes required for the generation of phage particles. Helper phages are useful to allow modified phages that lack a gene required for the generation of phage particles to complete the phage life cycle in a host cell. Typically, a helper phage will comprise the genes required for the generation of phage particles that are lacking in the phage genome, thus complementing the phage genome. In the continuous evolution context, the helper phage typically complements the selection phage, but both lack a phage gene required for the production of infectious phage particles.

The term "replication product," as used herein, refers to a nucleic acid that is the result of viral genome replication by a host cell. This includes any viral genomes synthesized by the host cell from a viral genome inserted into the host cell. The term includes non-mutated as well as mutated replication products.

The term "accessory plasmid," as used herein, refers to a plasmid comprising a gene required for the generation of infectious viral particles under the control of a conditional promoter. In the context of continuous evolution described herein, the conditional promoter of the accessory plasmid is typically activated by a function of the gene of interest to be evolved. Accordingly, the accessory plasmid serves the function of conveying a competitive advantage to those viral vectors in a given population of viral vectors that carry a gene of interest able to activate the conditional promoter. Only viral vectors carrying an "activating" gene of interest will be able to induce expression of the gene required to generate infectious viral particles in the host cell, and, thus, allow for packaging and propagation of the viral genome in the flow of host cells. Vectors carrying non-activating versions of the gene of interest, on the other hand, will not induce expression of the gene required to generate infectious viral vectors, and, thus, will not be packaged into viral particles that can infect fresh host cells.

In some embodiments, the conditional promoter of the accessory plasmid is a promoter the transcriptional activity of which can be regulated over a wide range, for example, over 2, 3, 4, 5, 6, 7, 8, 9, or 10 orders of magnitude by the activating function, for example, function of a protein encoded by the gene of interest). In some embodiments, the level of transcriptional activity of the conditional promoter depends directly on the desired function of the gene of interest. This allows for starting a continuous evolution process with a viral vector population comprising versions of the gene of interest that only show minimal activation of the conditional promoter. In the process of continuous evolution, any mutation in the gene of interest that increases activity of the conditional promoter directly translates into higher expression levels of the gene required for the generation of infectious viral particles, and, thus, into a competitive advantage over other viral vectors carrying minimally active or loss-of-function versions of the gene of interest.

The stringency of selective pressure imposed by the accessory plasmid in a continuous evolution procedure as provided herein can be modulated. In some embodiments, the use of low copy number accessory plasmids results in an elevated stringency of selection for versions of the gene of interest that activate the conditional promoter on the accessory plasmid, while the use of high copy number accessory plasmids results in a lower stringency of selection. The terms "high copy number plasmid" and "low copy number plasmid" are art-recognized and those of skill in the art will be able to ascertain whether a given plasmid is a high or low copy number plasmid. In some embodiments, a low copy number accessory plasmid is a plasmid exhibiting an average copy number of plasmid per host cell in a host cell population of about 5 to about 100. In some embodiments, a very low copy number accessory plasmid is a plasmid exhibiting an average copy number of plasmid per host cell in a host cell population of about 1 to about 10. In some embodiments, a very low copy number accessory plasmid is a single-copy per cell plasmid. In some embodiments, a high copy number accessory plasmid is a plasmid exhibiting an average copy number of plasmid per host cell in a host cell population of about 100 to about 5000. The copy number of an accessory plasmid will depend to a large part on the origin of replication employed. Those of skill in the art will be able to determine suitable origins of replication in order to achieve a desired copy number.

In some embodiments, the stringency of selective pressure imposed by the accessory plasmid can also be modulated through the use of mutant or alternative conditional transcription factors with higher or lower transcriptional output (e.g., a T7 RNA polymerase comprising a Q649S mutation). In some embodiments, the use of lower transcriptional output results in an elevated stringency of selection for versions of the gene of interest that activate the conditional promoter on the accessory plasmid, while the use of higher transcriptional output machinery results in a lower stringency of selection.

It should be understood that the function of the accessory plasmid, namely to provide a gene required for the generation of viral particles under the control of a conditional promoter the activity of which depends on a function of the gene of interest, can be conferred to a host cell in alternative ways. Such alternatives include, but are not limited to, permanent insertion of a gene construct comprising the conditional promoter and the respective gene into the genome of the host cell, or introducing it into the host cell using an different vector, for example, a phagemid, a cosmid, a phage, a virus, or an artificial chromosome. Additional ways to confer accessory plasmid function to host cells will be evident to those of skill in the art, and the invention is not limited in this respect.

The term "mutagen," as used herein, refers to an agent that induces mutations or increases the rate of mutation in a given biological system, for example, a host cell, to a level above the naturally-occurring level of mutation in that system. Some exemplary mutagens useful for continuous evolution procedures are provided elsewhere herein and other useful mutagens will be evident to those of skill in the art. Useful mutagens include, but are not limited to, ionizing radiation, ultraviolet radiation, base analogs, deaminating agents (e.g., nitrous acid), intercalating agents (e.g., ethidium bromide), alkylating agents (e.g., ethylnitrosourea), transposons, bromine, azide salts, psoralen, benzene, 3-chloro-4-(dichloromethyl)-5-hydroxy-2(5H)-furanone (MX) (CAS no. 77439-76-0), O,O-dimethyl-S-(phthalimidomethyl)phosphorodithioate (phos-met) (CAS no. 732-11-6), formaldehyde (CAS no. 50-00-0), 2-(2-furyl)-3-(5-nitro-2-furyl)acrylamide (AF-2) (CAS no. 3688-53-7), glyoxal (CAS no. 107-22-2), 6-mercaptopurine (CAS no. 50-44-2), N-(trichloromethylthio)-4-cyclohexane-1,2-dicarboximide (captan) (CAS no. 133-06-2), 2-aminopurine (CAS no. 452-06-2), methyl methane sulfonate (MMS) (CAS No. 66-27-3), 4-nitroquinoline 1-oxide (4-NQO) (CAS No. 56-57-5), N4-aminocytidine (CAS no. 57294-74-3), sodium azide (CAS no. 26628-22-8), N-ethyl-N-nitrosourea (ENU) (CAS no. 759-73-9), N-methyl-N-nitrosourea (MNU) (CAS no. 820-60-0), 5-azacytidine (CAS no. 320-67-2), cumene hydroperoxide (CHP) (CAS no. 80-15-9), ethyl methanesulfonate (EMS) (CAS no. 62-50-0), N-ethyl-N-nitro-N-nitrosoguanidine (ENNG) (CAS no. 4245-77-6), N-methyl-N-nitro-N-nitrosoguanidine (MNNG) (CAS no. 70-25-7), 5-diazouracil (CAS no. 2435-76-9), and t-butyl hydroperoxide (BHP) (CAS no. 75-91-2). Additional mutagens can be used in continuous evolution procedures as provided herein, and the invention is not limited in this respect.

Ideally, a mutagen is used at a concentration or level of exposure that induces a desired mutation rate in a given host cell or viral vector population, but is not significantly toxic to the host cells used within the average time frame a host cell is exposed to the mutagen or the time a host cell is present in the host cell flow before being replaced by a fresh host cell.

The term "mutagenesis plasmid," as used herein, refers to a plasmid comprising a gene encoding a gene product that acts as a mutagen. In some embodiments, the gene encodes a DNA polymerase lacking a proofreading capability. In some embodiments, the gene is a gene involved in the bacterial SOS stress response, for example, a UmuC, UmuD', or RecA gene. In some embodiments, the gene is a GATC methylase gene, for example, a deoxyadenosine methylase (dam methylase) gene. In some embodiments, the gene is involved in binding of hemimethylated GATC sequences, for example, a seqA gene. In some embodiments, the gene is involved with repression of mutagenic nucleobase export, for example emrR. In some embodiments, the gene is involved with inhibition of uracil DNA-glycosylase, for example a Uracil Glycosylase Inhibitor (ugi) gene. In some embodiments, the gene is involved with deamination of cytidine (e.g., a cytidine deaminase from *Petromyzon marinus*), for example, cytidine deaminase 1 (CDA1).

The term "host cell," as used herein, refers to a cell that can host a viral vector useful for a continuous evolution process as provided herein. A cell can host a viral vector if it supports expression of genes of viral vector, replication of the viral genome, and/or the generation of viral particles. One criterion to determine whether a cell is a suitable host cell for a given viral vector is to determine whether the cell can support the viral life cycle of a wild-type viral genome that the viral vector is derived from. For example, if the viral vector is a modified M13 phage genome, as provided in some embodiments described herein, then a suitable host cell would be any cell that can support the wild-type M13 phage life cycle. Suitable host cells for viral vectors useful in continuous evolution processes are well known to those of skill in the art, and the invention is not limited in this respect.

In some embodiments, modified viral vectors are used in continuous evolution processes as provided herein. In some embodiments, such modified viral vectors lack a gene required for the generation of infectious viral particles. In some such embodiments, a suitable host cell is a cell comprising the gene required for the generation of infectious viral particles, for example, under the control of a constitutive or a conditional promoter (e.g., in the form of an accessory plasmid, as described herein). In some embodiments, the viral vector used lacks a plurality of viral genes. In some such embodiments, a suitable host cell is a cell that comprises a helper construct providing the viral genes required for the generation of viral particles. A cell is not required to actually support the life cycle of a viral vector used in the methods provided herein. For example, a cell comprising a gene required for the generation of infectious viral particles under the control of a conditional promoter may not support the life cycle of a viral vector that does not comprise a gene of interest able to activate the promoter, but it is still a suitable host cell for such a viral vector. In some embodiments, the viral vector is a phage, and the host cell is a bacterial cell. In some embodiments, the host cell is an *E. coli* cell. Suitable *E. coli* host strains will be apparent to those of skill in the art, and include, but are not limited to, New England Biolabs (NEB) Turbo, Top10F', DH12S, ER2738, ER2267, XL1-Blue MRF', and DH10B. These strain names are art recognized, and the genotype of these strains has been well characterized. It should be understood that the above strains are exemplary only, and that the invention is not limited in this respect.

The term "fresh," as used herein interchangeably with the terms "non-infected" or "uninfected" in the context of host cells, refers to a host cell that has not been infected by a viral vector comprising a gene of interest as used in a continuous evolution process provided herein. A fresh host cell can, however, have been infected by a viral vector unrelated to the vector to be evolved or by a vector of the same or a similar type but not carrying the gene of interest. In some embodiments, the host cell is a prokaryotic cell, for example, a bacterial cell, such as an *E. coli* cell.

In some embodiments, the host cell is an *E. coli* cell. In some embodiments of PACE, for example, in embodiments employing an M13 selection phage, the host cells are *E. coli* cells expressing the Fertility factor, also commonly referred to as the F factor, sex factor, or F-plasmid. The F-factor is a bacterial DNA sequence that allows a bacterium to produce a sex pilus necessary for conjugation and is essential for the infection of *E. coli* cells with certain phage, for example, with M13 phage. For example, in some embodiments, the host cells for M13-PACE are of the genotype F'proA$^+$B$^+$Δ(lacIZY) zzf::Tn10(TetR)/endA1 recA1 galE15 galK16 nupG rpsL ΔlacIZYA araD139 Δ(ara, leu)7697 mcrA Δ(mrr-hsdRMS-mcrBC) proBA::pir116 λ$^{--}$. In some embodiments, the host cells for M13-PACE are of the genotype F'proA+B+Δ(lacIZY) zzf::Tn10(TetR) lacIQ1PN25-tetR luxCDE/endA1 recA1 galE15 galK16 nupG rpsL(StrR) ΔlacIZYA araD139 Δ(ara,leu)7697 mcrA Δ(mrr-hsdRMS-mcrBC) proBA::pir116 araE201 ΔrpoZ Δflu ΔcsgABCDEFG ΔpgaC λ—, for example S1030 cells as described in Carlson, J. C., et al. Negative selection and stringency modulation in phage-assisted continuous evolution. *Nat. Chem. Biol.* 10, 216-222 (2014). In some embodiments, the host cells for M13-PACE are of the genotype F' proA+B+Δ(lacIZY) zzf::Tn10 lacIQ1 PN25-tetR luxCDE Ppsp(AR2) lacZ luxR Plux groESL/endA1 recA1 galE15 galK16 nupG rpsL ΔlacIZYA araD139 Δ(ara,leu)7697 mcrA Δ(mrr-hsdRMS-mcrBC) proBA::pir116 araE201 ΔrpoZ Δflu ΔcsgABCDEFG ΔpgaC λ—, for example 52060 cells as described in Hubbard, B. P. et al. Continuous directed evolution of DNA-binding proteins to improve TALEN specificity. *Nature Methods* 12, 939-942 (2015).

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development. In some embodiments, the subject has a disease characterized by increased activity of an intracellular protein (e.g., a SNARE protein, PTEN, etc.). In some embodiments, the disease characterized by increased activity of an intracellular protein is cancer, transplantation rejection, graft-versus-host disease, ischemic neuronal injury (stroke), Parkinson's Disease, Huntington's Disease, Alzheimer's Disease, spinal cord injury, diabetes, autoimmune disorders, allergy, or Cushing Disease. In some embodiments, the subject has a disease characterized by increased activity of a SNARE protein (e.g., VAMP1, VAMP2, VAMP7, VAMPS, SNAP23, SNAP25, etc.). In some embodiments, the subject has a disease characterized by increased activity of a VAMP protein (e.g., VAMP7). In some embodiments, the disease characterized by increased VAMP7 activity is cancer, transplantation rejection, or graft-versus-host disease. In some embodiments, the subject has a disease characterized by increased expression of a VAMP8 protein. In some embodiments, the disease characterized by increased VAMP8 activity is cancer. In some embodiments, the subject has or is suspected of having a disease characterized neuro-degeneration and in which inhibition of PTEN activity could transiently induce cellular regeneration, for example, ischemic neuronal injury (stroke), Parkinson's Disease, Huntington's Disease, Alzheimer's Disease, or spinal cord injury. In some embodiments, the subject has or is suspected of having a disease characterized by hypersecretion and in which cleavage of SNAP23 could prevent said secretion, for example, diabetes, autoimmune disorders, allergy, and Cushing Disease.

The term "cell," as used herein, refers to a cell derived from an individual organism, for example, from a mammal. A cell may be a prokaryotic cell or a eukaryotic cell. In some embodiments, the cell is a eukaryotic cell, for example, a human cell, a mouse cell, a pig cell, a hamster cell, a monkey cell, etc. In some embodiments, a cell is characterized by increased VAMP7 expression, such as a neuronal cell. In some embodiments, a cell is obtained from a subject having or suspected of having a disease characterized by increased VAMP7 levels/expression, for example, cancer, transplantation rejection, or graft-versus-host disease, etc. In some embodiments, a cell is obtained from a subject having or suspected of having a disease characterized by increased PTEN levels/expression, for example, ischemic neuronal injury (stroke).

The term "intracellular environment," as used herein refers, to the aqueous biological fluid (e.g., cytosol) forming the microenvironment contained by the outer membrane of a cell. For example, in a subject, an intracellular environment may include the cytoplasm of a cell or cells of a target organ or tissue (e.g., the cytosol of neuronal cells in CNS tissue). In another example, a cellular environment is the cytoplasm of a cell or cells surrounded by cell culture growth media housed in an in vitro culture vessel, such as a cell culture plate or flask.

The term "increased activity," as used herein, refers to an increase in activity (e.g., via elevated expression) of a particular molecule in one cell or subject relative to a normal cell or subject that is not characterized by increased activity of that molecule (e.g., a "normal" or "control" cell or subject). For example, a cell having increased PTEN activity is characterized by more PTEN function (e.g., PTEN-mediated phosphatase activity) than a control cell having a normal (e.g., healthy) level of PTEN activity. In another example, a cell having increased VAMP7 activity is characterized by more VAMP7 activity (e.g., than a control cell expressing a normal (e.g., healthy) amount of VAMP7. Methods of determining relative expression levels of biomolecules (e.g., cytokines, proteins, nucleic acids, etc.) are known to the skilled artisan and include quantitative real-time PCR (q-RT-PCR), western blot, protein quantification assays (e.g., BCA assay), flow cytometry, etc.

As used herein, "aberrant activity" refers to an altered level of gene product (e.g., protein) activity in a cell or subject relative to a normal, healthy cell or subject. Examples of aberrant activity include but are not limited to increased activity of a gene product due to increased expression of the gene encoding the gene product, loss of activity of a gene product due to deceased expression of the gene encoding the gene product, altered function of a gene product due to epigenetic regulation of the gene encoding the gene product, etc., in a cell or subject relative to a normal, healthy cell or subject.

DETAILED DESCRIPTION

Introduction

Proteases are ubiquitous regulators of protein function in all domains of life and represent approximately one percent of known protein sequences. Substrate-specific proteases have proven useful as research tools and as therapeutics that supplement a natural protease deficiency to treat diseases, such as hemophilia, or that simply perform their native function such as in the case of botulinum toxin, which catalyzes the cleavage of SNARE proteins.

Researchers have engineered or evolved proteases for industrial use with enhanced thermostability and solvent tolerance. Similarly, a handful of therapeutic proteases have been engineered with improved kinetics and prolonged activity. The potential of proteases to serve as a broadly useful platform for degrading proteins implicated in disease, however, is greatly limited by the native substrate scope of known proteases. In contrast to the highly successful generation of therapeutic monoclonal antibodies with tailor-made binding specificities, the generation of proteases with novel protein cleavage specificities has proven to be a challenge.

The evolution of a protease that can degrade a target protein of interest often necessitates changing substrate sequence specificity at more than one position, and thus may require many generations of evolution. Continuous evolution strategies, which require little or no researcher intervention between generations, therefore may be well-suited to evolve proteases capable of cleaving a target protein that differs substantially in sequence from the preferred substrate of a wild-type protease. In phage-assisted continuous evolution (PACE), a population of evolving selection phage (SP) is continuously diluted in a fixed-volume vessel by an incoming culture of host cells, e.g., *E. coli*. The SP is a modified phage genome in which the evolving gene of interest has replaced gene III, a gene essential for phage infectivity. If the evolving gene of interest possesses the desired activity, it will trigger expression of gene III from an accessory plasmid (AP) in the host cell, thus producing infectious progeny encoding active variants of the evolving gene. The mutation rate of the SP is controlled using an inducible mutagenesis plasmid (MP), such as MP6 (for example as described in International PCT Application, PCT/US2016/027795, filed on Apr. 15, 2016, published as WO2016/168631 on Oct. 20, 2016, the entire contents of which are incorporated herein by reference), which upon induction increases the mutation rate of the SP by >300,000-fold. Because the rate of continuous dilution is slower than phage replication but faster than *E. coli* replication, mutations only accumulate in the SP.

Some aspects of this disclosure are based on the recognition that PACE can be employed for the directed evolution of proteases, in particular the evolution of proteases that cleave intracellular proteins (e.g., VAMP1, VAMP2, VAMP7, VAMP8, SNAP23, PTEN, etc.). In some embodiments, proteases described by the disclosure are evolved from wild-type Botulinum toxin (BoNT) proteases, for example, BoNT E or BoNT F. Proteases may require many successive mutations to remodel complex networks of contacts with polypeptide substrates and are thus not readily manipulated by conventional, iterative evolution methods. The ability of PACE to perform the equivalent of hundreds of rounds of iterative evolution methods within days enables complex protease evolution experiments, that are impractical with conventional methods.

This disclosure provides data illustrating the feasibility of PACE-mediated evolution of the BoNT proteases (e.g., BoNT E or BoNT F) to cleave intracellular proteins (e.g., VAMP7, VAMP8, PTEN, etc.). As described in the Examples, BoNT E protease, which natively cleaves the consensus substrate sequence MGNEIDTQNRQIDRIMEKAD (SEQ ID NO: 310), was evolved by PACE to cleave a target sequence, NGSLCDQEIDSICSIERADN (SEQ ID NO: 311), that differs from the consensus substrate and is present in PTEN. Also described in the Examples, BoNT F protease, which natively cleaves the consensus substrate sequence TSNRRLQQTQAQVEEVVDIIRVNVDKVLER-DQKLSELDDRADALQAGASQFESSAAKL KR (SEQ ID NO: 312), was evolved by PACE to cleave a target sequence, GGSGGSGG-SKGLDKVMETQAQVDELKGIMVRNIDLVAQRGER-LELLIDKTENLVDSSV TFKTTSRNLARGGSGGSGGS (SEQ ID NO: 313). It was observed that after constructing a pathway of evolutionary stepping-stones and performing ~2,000 generations of evolution using PACE, the resulting BoNT protease variants (e.g., BoNT E variants and BoNT F variants) contain up to 20 amino acid substitutions relative to wild-type BoNT proteases (e.g., SEQ ID NO: 286 or 287) and cleave human VAMP7 or PTEN at the intended target peptide bond. Together, the work described herein establishes a platform for generating proteases (e.g., BoNT protease variants) with changed substrate specificities and the ability to cleave proteins implicated in human disease.

PACE technology has been described previously, for example, in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; and U.S. Application, U.S. Ser. No. 13/922,812, filed Jun. 20, 2013; International PCT Application, PCT/US2015/057012, filed on Oct. 22, 2015, published as WO2016/077052; and, PCT/US2016/027795, filed on Apr. 15, 2016, published as WO2016/168631, each of which is incorporated herein by reference. Those of skill in the art will understand that the PACE technology, strategies, methods, compositions, systems, and reagents provided herein can be used in combination with many aspects of the PACE technology described in those applications, for example, with the apparatuses, lagoons, host cell types, cell flow parameters, selection stringencies (e.g., high selection stringency, low selection stringency, etc.), positive selection strategies, negative selection strategies, plasmids, vectors, etc., disclosed in those applications.

Variant BoNT Proteases and Uses Thereof

This disclosure provides variants of BoNT proteases that are derived from a wild-type BoNT E or BoNT F protease (e.g., SEQ ID NO: 286 or 287) and have at least one of the amino acid variations present in Table 1 or Table 2. The variation in amino acid sequence generally results from a mutation, insertion, or deletion in a DNA coding sequence. Mutation of a DNA sequence can result in a nonsense mutation (e.g., a transcription termination codon (TAA, TAG, or TAA) that produces a truncated protein), a missense mutation (e.g., an insertion or deletion mutation that shifts the reading frame of the coding sequence), or a silent mutation (e.g., a change in the coding sequence that results in a codon that codes for the same amino acid normally present in the cognate protein, also referred to sometimes as a synonymous mutation). In some embodiments, mutation of a DNA sequence results in a non-synonymous (i.e., conservative, semi-conservative, or radical) amino acid substitution.

Generally, wild-type BoNT protease is encoded by a gene of the microorganism *Clostridium botulinum*. The amount or level of variation between a wild-type BoNT protease and a BoNT protease variant provided herein can be expressed as the percent identity of the nucleic acid sequences or amino acid sequences between the two genes or proteins. In some embodiments, the amount of variation is expressed as the percent identity at the amino acid sequence level. In some embodiments, a BoNT protease variant and a wild-type BoNT protease are from about 70% to about 99.9% identical, about 75% to about 95% identical, about 80% to about 90% identical, about 85% to about 95% identical, or about 95% to about 99% identical at the amino acid sequence level. In some embodiments, a BoNT protease variant comprises an amino acid sequence that is at least 95%, at least 99%, or at least 99.9% identical to the amino acid sequence of a wild-type BoNT protease.

In some embodiments, a variant BoNT protease is about 70%, about 71%, about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 99.9% identical to a wild-type BoNT protease.

Some aspects of the disclosure provide variant BoNT proteases having between about 90% and about 99.9% (e.g., about 90%, about 90.5%, about 91%, about 91.5%, about 92%, about 92.5%, about 93%, about 93.5%, about 94%, about 94.5%, about 95%, about 95.5%, about 96%, about 96.5%, about 97%, about 97.5%, about 98%, about 98.5%, about 99%, about 99.2%, about 99.4%, about 99.6%, about 99.8%, or about 99.9%) identical to a wild-type BoNT protease as set forth in SEQ ID NO: 286 or 287. In some embodiments, the variant BoNT protease is no more than 99.9% identical to a wild-type BoNT protease.

Some aspects of the disclosure provide variant BoNT proteases having between 1 and 20 amino acid substitutions (e.g., mutations) relative to a wild-type BoNT protease (e.g., SEQ ID NO: 286 or 287). In some embodiments, a variant BoNT protease has 1, 2, 3, 4, 5, 6, 7, 8, 9, 10, 11, 12, 13, 14, or 15 amino acid substitutions relative to a wild-type BoNT protease (e.g., SEQ ID NO: 286 or 287).

The amount or level of variation between a wild-type BoNT protease and a variant BoNT protease can also be expressed as the number of mutations present in the amino acid sequence encoding the variant BoNT protease relative to the amino acid sequence encoding the wild-type BoNT protease. In some embodiments, an amino acid sequence encoding a variant BoNT protease comprises between about 1 mutation and about 100 mutations, about 10 mutations and about 90 mutations, about 20 mutations and about 80 mutations, about 30 mutations and about 70 mutations, or about 40 and about 60 mutations relative to an amino acid sequence encoding a wild-type BoNT protease. In some embodiments, an amino acid sequence encoding a variant BoNT protease comprises more than 100 mutations relative to an amino acid sequence encoding a wild-type BoNT protease. In some embodiments, the variant BoNT protease comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34 or 35 amino acid variations selected from the variations (e.g., amino acid substitutions) provided in Table 1. In some embodiments, the variant BoNT protease comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34 or 35 amino acid variations selected from the variations (e.g., amino acid substitutions) provided in Table 2.

TABLE 1

Unique BoNT E Mutations

| | | | |
|---|---|---|---|
| Q354R | T400K | Y355H | Y357S |
| G101S | V265G | F186L | C26Y |
| D312N | I409T | N118D | N238S |
| V345I | T400A | Q27R | S198G |
| M172R | I247V | Q27H | Y20C |
| M172S | T160S | A224S | I21M |
| M172V | K225Y | N138D | L98P |
| I227T | K245R | N161W | E28K |
| I227V | Q141R | N161V | I409L |
| S372G | S99T | Y68H | Y357C |
| A266T | A313S | Y171C | I352T |
| I263V | V132G | S6G | A129Q |
| F358L | C231G | E159S | S162A |
| N197K | N379K | E159R | Y357H |
| M172K | D128G | E159W | S174A |
| Q295R | K311E | I352V | E159Q |
| S99A | S314A | I232T | Y357W |
| N161Y | K225H | V47I | L404* |
| E154G | C231R | E78G | E148G |
| E159L | Q27K | S137R | Y357P |
| N242S | K225L | E159A | I302M |
| D128A | K22S | E159C | I399S |
| I199M | K22R | I352A | E184G |
| T160A | K329N | S163R | T119K |
| A389T | D53Y | R168K | S162Q |
| I165V | N161H | I232S | A129G |
| I18V | E89P | Q141K | S187F |
| I199T | K225E | I233T | N258D |
| N261D | D270N | I396S | P398L |

TABLE 2

Unique BoNT F Mutations

| | | | |
|---|---|---|---|
| A63D | I139V | V422I | N6S |
| E105A | N165T | V422L | Y10C |
| Y113H | N165S | K283E | R49L |
| Y113D | N358T | F267L | I52V |
| S70F | D175A | N305T | D58Y |
| A63T | D161N | S136I | E60D |
| E66D | P221R | D382Y | E66K |
| T79S | N101T | S176G | S70H |
| K96N | Y113S | A291V | T90I |
| K172R | I277L | L421W | T123M |
| N76D | S167C | K146R | T123S |
| R303H | N101I | S176N | T132I |
| S189I | S30N | Y316N | V145I |
| S244I | K342R | E310G | G159S |
| H129Y | D60Y | G241S | D161G |
| Y210C | D185A | Y294C | N184K |
| V426* | A330E | D55N | Y201H |
| N184H | I385V | K411E | N211S |
| E338K | I39V | A307S | F217L |
| Y294H | R244C | S100I | A226S |
| G420A | S213Y | F341L | A232T |
| G420C | D60E | I416V | I262T |
| Y199H | E164G | A292S | L264M |
| G420V | N11S | K411N | D274M |
| A82V | E259G | G209D | N314S |
| Q109H | Y244C | Y253S | G325S |
| P197S | E164K | D175G | D331G |
| S350I | T243A | S415P | S333F |
| E200K | T214A | D274E | T335I |

TABLE 2-continued

Unique BoNT F Mutations

| | | | |
|---|---|---|---|
| N339T | D355G | E215K | N339S |
| N379D | T279C | I370V | F360I |
| R41H | F374L | S207N | T367S |
| R300H | V362A | I425T | F369F |
| E200A | K371E | I425S | V377I |
| E121K | N329D | N211D | N379H |
| E423R | Y201D | A103V | K29E |
| E121D | T214G | K347N | K31N |
| N184S | N40T | S389N | Y72H |
| I190V | T214S | I286N | N99S |
| F428S | L375R | D414G | V106A |
| Y237S | N211H | A63V | Y113C |
| R303C | T299M | M174T | V131G |
| T335S | R240L | G177A | S141T |
| S350G | R240F | G178A | I150T |
| F360L | F267I | N184T | V155I |
| Y372H | F270V | V193M | S166Y |
| N396H | N293D | E200G | S167I |
| P410L | I297L | Y210H | T214I |
| D418Y | E215G | E423K | N409D |
| F420S | S224I | E423K | S224V |

Particular combinations of mutations present in an amino acid sequence encoding a variant BoNT protease can be referred to as the "genotype" of the variant BoNT protease. For example, a variant BoNT E protease genotype may comprise the mutations Q27H, S99A, G101S, N118D, E159L, N161Y, S162Q, S163R, M172K, I132T, Q354R, Y357P, relative to a wild-type BoNT E protease (e.g., SEQ ID NO: 286; wild-type BoNT E). In some embodiments, a BoNT F variant genotype comprises the following mutations: V106A, S166Y, S167I, E200G, S224I R240L, S350G, F360L, Y372H, P410L, G420A, L421W, V422L, E423R, I425S, and V426* (e.g., a stop codon). In some embodiments, a BoNT F variant genotype comprises the following mutations: S166Y, N184K, E200G, S224I, R240F, T335S, F360L Y372H, N396H, P410L, D418Y, and E423K. Further examples of variant BoNT protease genotypes are shown in Tables 8-27, 29 and 30.

In some embodiments, a variant BoNT protease comprises at least 3, at least 4, at least 5, at least 6, at least 7, at least 8, at least 9, at least 10, at least 11, at least 12, at least 13, at least 14, at least 15, at least 16, at least 17, at least 18, at least 19, or at least 20 mutations provided in Table 1 or Table 2. In some embodiments, the at least one mutation is selected from the group consisting of: I18V, C26Y, Q27H, E28K, F29L, Y68H, L89P, S99A, S99T, G101S, N118D, G127S, Q141K, E154G, E159L, N161Y, S162Q, S163R, R168K, M172K, K225E, C231R, I232T, I233T, N238S, Q295R, I396S, P398L Q354R, Y357P, L404*, and I409T. In some embodiments, the at least one mutation is selected from the group consisting of: Q27H, S99A, G101S, N118D, E159L, N161Y, S162Q, S163R, M172K, I132T, Q354R, and Y357P. In some embodiments, a variant BoNT protease as described herein comprises or consists of a sequence selected from SEQ ID NOs: 1-285 given in Table 28. In some embodiments, the lowercase amino acid residues indicate the amino acid substitutions.

TABLE 28

| Sequence | SEQ ID NO |
|---|---|
| MPKINTSFNYNDPVNDRTILYIKPGGCkEFYKSFNIMKNIWIIPERNVIGTT<br>PQDFHPPTSLKNGDSSYYDPNYLQSDEEKDRFLKIVTKIFNRIMNNLSGG<br>ILLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAhGITTTCsITQQQNPLITNRKGINIEEFLTFG<br>GNDLNIITVAQYNDIYTNLLNDYRKIASKLSKVQVSNPQLNPYKDIFQE | 1 |

TABLE 28-continued

| Sequence | SEQ ID NO |
|---|---|
| KYGLDKDASGIYSVNINKFDDILKKLYSFTEFDLATKFQVKCRETYIGQ<br>YKYFKLSNLLNDSIYNISEGYNINNLKVNFRGQNANLNPRIIKPITGRGL<br>VKKIIRF | |
| MPKINTSFNYNDPVNDRTILYIKPGGCQkFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAlGITTTCIITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYtGQ<br>YKYFKLSNLLNDSIYNISEGYNINNLKVNFRGQNANLNPRIIKPITGRGL<br>VKKIIRF | 2 |
| MPKINTSFNYNDPVNDRTILYIKPGGCQEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAlGITTTCIITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGQ<br>YKYFKLSNLLNDSIYNISEGYNINNLKVNFRGQNANLNPRIIKPITGRGL<br>VKKIIRF | 3 |
| MPKINSFNYNDPVNDRTILYIKPGGCkEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAhGITTTCIITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGQ<br>YKYFKLSNLLNDSIYNISEGYNINNLKVNFRGQNANLNPRIIKPITGRGL<br>VKKIIRF | 4 |
| MPKINSFNYNDPVNDRTILYIKPGGCQkFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAhGITTTCtITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGQ<br>YKYFKLSNLLNDSIYNISEGYNINNLKVNFRGQNANLNPRIIKPITGRGL<br>VKKIIRF | 5 |
| MPKINSFNYNDPVNDRTILYIKPGGCQkFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAhGITTTCIITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGQ<br>YKYFKLSNLLNDSIYNISEGYNINNLKVNFRGQNANLNPRIIKPITGRGL<br>VKKIIRF | 6 |
| MPKINSFNYNDPVNDRTILYIKPGGCQEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFaThSSNISLRNNYMPSNHGFGSIAIVTFSPEYSFRFNDNSINEFIQ<br>DPALTLMHELIHSLHGLYGAKGITTTCsITQQQNPLITNRKGINIEEFLTF<br>GGNDLNIITVAQYNDIYTNLLNDYRKIASKLSKVQVSNPQLNPYKDIFQ<br>EKYGLDKDASGIYSVNINKFDDILKKLYSFTEFDLATKFQVKCRETYIGQ<br>YKYFKLSNLLNDSIYNISEGYNINNLKVNFRGQNANLNPRIIKPITGRGL<br>VKKIIRF | 7 |
| MPKINSFNYNDPVNDRTILYIKPGGCkEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFaThSSNISLRNNYMPSNHGFGSIAIVTFSPEYSFRFNDNSINEFIQ<br>DPALTLMHELIHSLHGLYGAKGITTTCIITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGQ<br>YKYFKLSNLLNDSIYNISEGYNINNLKVNFRGQNANLNPRIIKPITGRGL<br>VKKIIRF | 8 |
| MPKINSFNYNDPVNDRTILYIKPGGCkEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDNSINEFIQ | 9 |

| Sequence | SEQ ID NO |
|---|---|
| DPALTLMHELIHSLHGLYGAKGITTTCsITQQQNPLITNRKGINIEEFLTF<br>GGNDLNIITVAQYNDIYTNLLNDYRKIASKLSKVQVSNPQLNPYKDIFQ<br>EKYGLDKDASGIYSVNINKFDDILKKLYSFTEFDLATKFQVKCRETYIGQ<br>YKYFKLSNLLNDSIYNISEGYNINNLKVNFRGQNANLNPRIIKPITGRGL<br>VKKIIRF | |
| MPKINSFNYNDPVNDRTILYIKPGGCQEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFaTNSSNISLRNNYMPSNHGFGSIAIVTFSPEYSFRFNDNSINEFIQ<br>DPALTLMHELIHSLHGLYGAKGITTTCtITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGQ<br>YKYFKLSNLLNDSIYNISEGYNINNLKVNFRGQNANLNPRIIKPITGRGL<br>VKKIIRF | 10 |
| MPKINSFNYNDPVNDRTILYIKPGGCQEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFlTySSNISLRNNYMPSNHGFGSIAIVTFSPEYSFRFNDNSINEFIQD<br>PALTLMHELIHSLHGLYGAKGITTTCIITQQQNPLITNRKGINIEEFLTFGG<br>NDLNIITVAQYNDIYTNLLNDYRKIASKLSKVQVSNPQLNPYKDIFQEK<br>YGLDKDASGIYSVNINKFDDILKKLYSFTEFDLATKFQVKCRETYIGQY<br>KYFKLSNLLNDSIYNISEGYNINNLKVNFRGQNANLNPRIIKPITGRGLV<br>KKIIRF | 11 |
| MPKINSFNYNDPVNDRTILYIKPGGCQkFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFsThSSNISLRNNYMPSNHGFGSIAIVTFSPEYSFRFNDNSINEFIQ<br>DPALTLMHELIHSLHGLYGAKGITTTCIITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGQ<br>YKYFKLSNLLNDSIYNISEGYNINNLKVNFRGQNANLNPRIIKPITGRGL<br>VKKIIRF | 12 |
| MPKINSFNYNDPVNDRTILYIKPGGCQEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFaTySSNISLRNNYMPSNHGFGSIAIVTFSPEYSFRFNDNSINEFIQ<br>DPALTLMHELIHSLHGLYGAKGITTTCIITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGQ<br>YKYFKLSNLLNDSIYNISEGYNINNLKVNFRGQNANLNPRIIKPITGRGL<br>VKKIIRF | 13 |
| MPKINSFNYNDPVNDRTILcIKPGGCQkFYKSFNIMKNIWIIPERNVIGTTP<br>QDFHPPTSLKNGDSSYYDPNYLQSDgEKDRFLKIVTKIFNRINNNLSGGI<br>LLEELSKANPYLGNDNTPDNQFHIGaqSAVEIKFSNGSQHILLPNVIIMGA<br>EPDLFETNSSNISLRNNYMPSNHGFGSIAIVTFSPEYSFRFNDNSINEFIQD<br>PALTLMHELIHSLHGLYGAKGITTTCIITQQQNPLITNRKGINIEEFLTFGG<br>NDLNIITVAQYNDIYTNLLNDYRKIASKLSKVQVSNPQLNPYKDIFQEK<br>YGLDKDASGIYSVNINKFDDILKKLYSFTEFDLATKFQiKCRETYIGQYK<br>YFKLSNLLNDSIYNISEGYNINNLKVNFRGQNANLNPRIIKPITGRG*VKK<br>IIRF | 14 |
| MPKINSFNYNDPVNDRTILYIKPGGCQEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGggSAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAKGITTTCIITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGQ<br>YKYFKLSNLLNDSIYNISEGYNINNLKVNFRGQNANLNPRIIKPsTGRGL<br>VKKIIRF | 15 |
| MPKINSFNYNDPVNDRTILYIKPGGCQEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGgqSAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAKGITTTCIITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGQ<br>YKYFKLSNLLNDSIYNISEGYNINNLKVNFRGQNANLNPRIIKPITGRGL<br>VKKIIRF | 16 |
| MPKINSFNYNDPVNDRTILYIKPGGCQEFYKSFNIMKNIWIIPERNVIGTT<br>PQDFHPPTSLKNGDSSYYDPNYLQSDEEKDRFLKIVTKIFNRINNNLSGG | 17 |

TABLE 28-continued

| Sequence | SEQ ID NO |
|---|---|
| ILLEELSKANPYLGNDNTPDNQFHIGaqSAVEIKFSNGSQHILLPNVIIMG AEPDLFETNSSNISLRNNYMPSNHGFGSIAIVTFSPEYSFRFNDNSINEFIQ DPALTLMHELIHSLHGLYGAKGtTTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGaqSAVEIKFSNGSQHILLPNVIIMG AEPDLFETNSSNISLRNNYMPSNHGFGSIAIVTFSPEYSFRFNDNSINEFIQ DPALTLMHELIHSLHGLYGAKGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPIaGRGLV KKIIRF | 18 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFETNSSNISLRNNYMPSNHGFGSIAIVTFSPEYSFRFNDNSINEFIQ DPALTLMHELIHSLHGLYGAKGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 19 |
| MPKINSFNYNDPVNDRTILYIKPGGCQkFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFETNSSNISLRNNYMPSNHGFGSIAIVTFSPEYSFRFNDNSINEFIQ DPALTLMHELIHSLHGLYGAKGITTTCtITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 20 |
| MPKINSFNYNDPVNDRTILYIKPGGCQkFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFETNSSNvSLRNNYMPSNHGFGSIAIVTFSPEYSFRFNDNSINEFIQ DPALTLMHELIHSLHGLYGAKGITTTCtITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 21 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGsI LLEELSKANPYLGNDNTPDNQFHIGDASAVEIKFSNGSQHILLPNVIIMG AEPDLFETNSSNISLkNNYMPSNHGFGSIAIVTFSPEYSFRFNDNSINEFIQ DPALTLMHELIHSLHGLYGAKGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 22 |
| MPKINSFNYNDPVNDRTILYIKPGGCQkFYKSFNIMKNIWIIPERNVIGTT PQDFHPPTSLKNGDSSYYDPNYLQSDEEKDRFLKIVTKIFNRINNNpSGGI LLEELSKANPYLGNDNTPDNQFHIGDASAVEIKFSNGSQHILLPNVIIMG AEPDLFETNSSNISLRNNYMPSNHGFGSIAIVTFSPEYSFRFNDNSINEFIQ DPALTLMHELIHSLHGLYGAKGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYlKLSNLLNDSIYNISEGYNINNLKVNFRGQNANLNPRIIKPITGRGLV KKIIRF | 23 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFETNSSNISLRNNYMPSNHGFGSIAIVTFSPEYSFRFNDNSINEFIQ DPALTLMHELIHSLHGLYGAKGITTTCsITQQQNPLITNRKGINIEEFLTF GGNDLNIITVAQYNDIYTNLLNDYRKIASKLSKVQVSNPQLNPYKDIFQ EKYGLDKDASGIYSVNINKFDDILKKLYSFTEFDLATKFQVKCRETYIGQ YKYFKLSNLLNDSIYNISEGYNINNLKVNFRGQNANLNPRIIKPIkGRGLV KKIIRF | 24 |

TABLE 28-continued

| Sequence | SEQ ID NO |
|---|---|
| MPKINSFNYNDPVNDRTILYIKPGGCQkFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFETNSSNISLRNNYMPSNHGFGSIAIVTFSPEYSFRFNDNSINEFIQ DPALTLMHELIHSLHGLYGAKGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 25 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGsI LLEELSKANPYLGNDNTPDNQFHIGDASAVEIKFSNGSQHILLPNVIIMG AEPDLFETNSSNISLkNNYMPSNHGFGSIAIVTFSPEYSFRFNDNSINEFIQ DPALTLMHELIHSLHGLYGAKGITTTCtITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 26 |
| MPKINSFNYNDPVNDRTILYIKPGGCQkFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFETNSSNISLRNNYMPSNHGFGSIAIVTFSPEYSFRFNDNSINEFIQ DPALTLMHELIHSLHGLYGAlGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 27 |
| MPKINSFNYNDPVNDRTILYIKPGGCrEFYKSFNIMKNIWIIPERNVIGTTP QDFHPPTSLKNGDSSYYDPNYLQSDEEKDRFLKIVTKIFNRINNNpSGGI LLEELSKANPYLGNDNTPDNQFHIGDASAVEIKFSNGSQHILLPNVIIMG AEPDLFETNSSNISLRNNYMPSNHGFGSIAIVTFSPEYSFRFNDkSmNEFIQ DPALTLMHELIHSLHGLYGAhGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 28 |
| MPKINSFNYNDPVNDRTILYIKPGGCQkFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFETNSSNISLRNNYMPSNHGFGSIAIVTFSPEYSFRFNDNSINEFIQ DPALTLMHELIHSLHGLYGAlGvTTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYtGQ YKYFKLSNLLNDSIYNISEGYNINNLKVNFRGQNANLNPRIIKPITGRG*V KKIIRF | 29 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFETNSSNISLRNNcMPSNHGFGSIAIVTFSPEYSFRFNDNSINEFIQ DPALTLMHELIHSLHGLYGshGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 30 |
| MPKINSFNYNDPVNDRTILYIsPGGCQkFYKSFNIMKNIWIIPERNVIGTTP QDFHPPTSLKNGDSSYYDPNYLQSDEEKDRFLKIVTKIFNRINNNLSGGI LLEELSKANPYLGNDNTPDNQFHIGDASAVEIKFSNGSQHILLPNVIIMG AEPDLFETNSSNISLRNNYMPSNHGFGSIAIgTFSPEYSFRFNDNSINEFIQ DPALTLMHELIHSLHGLYGAhGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKcFKLSNLLNDSIYNISEGYNINNLKVNFRGQNANLNPRIIKPITGRGLV KKIIRF | 31 |

TABLE 28-continued

| Sequence | SEQ ID NO |
|---|---|
| MPKINSFNYNDPVNDRTILYIKPGGCQEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAKGITTTCtITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGQ<br>YKYFKLSNLLNDSIYNISEGYNINNLKVNFRGQNANLNPRIIKPITGRGL<br>VKKIIRF | 32 |
| MPKINSFNYNDPVNDRTILYIKPGGCQEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAKGITTTCtITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGrh<br>KYFKLSNLLNDSIYNISEGYNINNLKVNFRGQNANLNPRIIKPITGRGLV<br>KKIIRF | 33 |
| MPKINSFNYNDPVNDRTILYIKPGGCQEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAKGITTTCtITQQQNPLITNRKGINIEEFLTFG<br>GNDLNIITgAQYNDIYTNLLNDYRKIASKLSKVQVSNPQLNPYKDIFQEK<br>YGLDKDASGIYSVNINKFDDILKKLYSFTEFDLATKFQVKCRETYIGQY<br>KYFKLSNLLNDSIYNISEGYNINNLKVNFRGQNANLNPRIIKPITGRGLV<br>KKIIRF | 34 |
| MPKINSFNYNDPVNDRTILYIKPGGCQEFYKSFNIMKNIWIIPERNiIGTTP<br>QDFHPPTSLKNGDSSYYDPNYLQSDEEKDRFLKIVTKIFNRINNNpSGGI<br>LLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAKGITTTCtITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGQ<br>YKYFKLSNLLNDSIYNIgEGYNINNLKVNFRGQNANLNPRIIKPITGRGL<br>VKKIIRF | 35 |
| MPKINSFNYNDPVNDRTILYIKPGGCQEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAKGITTTCtITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGrh<br>KYFKLSNLLNDSIYNISEGYNINkLKVNFRGQNANLNPRIIKPITGRGLVK<br>KIIRF | 36 |
| MPKINSFNYNDPVNDRTILYIKPGGCQEFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDkSINEFIQ<br>DPALTLMHELIHSLHGLYGAKGITTTCtITQQQNPLITNRKGINIEEFLTFG<br>GNDLNIITVAQYNDIYTNLLNDYRKIASKLSKVQVSNPQLNPYKDIFQE<br>KYGLDKDAaGIYSVNINKFDDILKKLYSFTEFDLATKFQVKCRETYIGrh<br>KYFKLSNLLNDSIYNISEGYNINNLKVNFRGQNANLNPRIIKPITGRGLV<br>KKIIRF | 37 |
| MPKINSFNYNDPVNDRTILYIKPGGCQkFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFsThSSNISLRNNYsPSNHGFGSIAIVTFSPEYSFRFNDNSINEFIQD<br>PALTLMHELIHSLHGLYGAhGITTTgIITQQQNPLITNRKGINIEEFLTFGG<br>NDLNIITVAQYNDIYTNLLNDYRKIASKLSKVQVSNPQLNPYKDIFQEK<br>YGLDKDASGIYSVNINKFDDILKKLYSFTEFDLATKFQVKCRETYIGQY<br>KYFKLSNLLNDSIYNISEGYNINNLKVNFRGQNANLNPRIIKPITGRGLV<br>KKIIRF | 38 |

TABLE 28-continued

| Sequence | SEQ ID NO |
|---|---|
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFsTwSSNISLRNNYMPSNHGFGSIAIVTFSPEYSFRFNDNSINEFIQ DPALTLMHELIHSLHGLYGAlGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYtGQ YKYFKLSNLLNDSIYNISEGYNINNLKVNFRGQNANLNPRIIKPITGRGL VKKIlRF | 39 |
| MPKINSFNYNDPVNDRTILYIKPGGCrEFYKSFNIMKNIWIIPERNVIGTTP QDFHPPTSLKNGDSSYYDPNYLQSDEEKDRFLKIVTKIFNRINNNpSGGI LLEELSKANPYLGNDNTPDNQFHIGDASAVEIKFSNGSQHILLPNVIIMG AEPDLFwTwSSNISLRNNYMPSNHGFGSIAIVTFSPEYSFRFNDNSINEFIQ DPALTLMHELIHSLHGLYGAhGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 40 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFqTySSNISLRNNYMPSNHGFGSIAIVTFSPEYSFRFNDNSINEFIQ DPALTLMHELIHSLHGLYGAhGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 41 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFaTwSSNISLRNNYvPSNHGFGSIAIVTFSPEYSFRFNDNSINEFIQD PALTLMHELIHSLHGLYGAlGITTTrIITQQQNPLITNRKGINIEEFLTFGGN DLNIITVAQYNDIYTNLLNDYRKIASKLSKVQVSNPQLNPYKDIFQEKY GLDKDASGIYSVNINKFDDILKKLYSFTEFDLATKFQVKCRETYIGQYK YFKLSNLLNDSIYNISEGYNINNLKVNFRGQNANLNPRIIKPITGRGLVK KIIRF | 42 |
| MPKINSFNYNDPVNDRTILYIKPGGCrEFYKSFNIMKNIWIIPERNVIGTTP QDFHPPTSLKNGDSSYYDPNYLQSDEEKDRFLKIVTKIFNRINNNpSGGI LLEELSKANPYLGNDNTPDNQFHIGDASAVEIKFSNGSQHILLPNVIIMG AEPDLFaTvSSNISLRNNYMPSNHGFGSIAIVTFSPEYSFRFNDNSINEFIQ DPALTLMHELIHSLHGLYGAhGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 43 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNpSGGI LLEELSKANPYLGNDNTPDNQFHIGDASAVEIKFSNGSQHILLPNVIIMG AEPDLFcTwSSNISLRNNYMPSNHGFGSIAIVTFSPEYSFRFNDNSINEFIQ DPALTLMHELIHSLHGLYGAlGITTTrIITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGQY KYFKLSNLLNDSIYNISEGYNINNLKVNFRGQNANLNPRIIKPITGRGLV KKIIRF | 44 |
| MPKINSFNYNDPVNDRTILYIKPGGCQkFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFETNSSNISLRNNYMPSNHGFGSIAIVTFSPEYSFRFNDNSINEFIQ DPALTLMHELIHSLHGLYGAlGITTTCtITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 45 |

TABLE 28-continued

| Sequence | SEQ ID NO |
|---|---|
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFETNSSNISLRNNYMPSNHGFGSIAIVTFSPEYSFRFNDNSINEFIQ DPALTLMHELIHSLHGLYGAlGITTTCtITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 46 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFaThSSNISLRNNYMPSNHGFGSIAIVTFSPEYSFRFNDNSINEFIQ DPALTLMHELIHSLHGLYGAyGITTTCtITQQQNPLIsNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 47 |
| MPKINSFNYNDPVNDRTILYIKPGGCQkFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFETNSSNISLRNNYMPSNHGFGSIAIVTFSPEYSFRFNDNgINEFIQ DPALTLMHELIHSLHGLYGAlGITTTCtITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 48 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFaThSSNISLRNNYMPSNHGFGSIAIVTFSPEYSFRFNDNSINEFIQ DPALTLMHELIHSLHGLYGAhGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 49 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNgIIMG AEPDLFETNSSNISLRNNYMPSNHGFGSIAIVTFSPEYSFRFNDNSINEFIQ DPALTLMHELIHSLHGLYGAhGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKhFKLSNLLNDSIYNISEGYNINNLKVNFRGQNANLNPRIIKPITGRGLV KKIIRF | 50 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNgIIMG AEPDLFETNSSNISLRNNYMPSNHGFGSIAIVTFSPEYSFRFNDNSINEFIQ DPALTLMHELIHSLHGLYGAhGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKcFKLSNLLNDSIYNISEGYNINNLKVNFRGQNANLNPRIIKPITGRGLV KKIIRF | 51 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNgIIMG AEPDLFETNSSNISLRNNYMPSNHGFGSIAIVTlSPEYSFRFNDNSINEFIQ DPALTLMHELIHSLHGLYGAhGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKcFKLSNLLNDSIYNISEGYNINNLKVNFRGQNANLNPRIIKPITGRGLV KKIIRF | 52 |

TABLE 28-continued

| Sequence | SEQ ID NO |
|---|---|
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNgIIMG AEPDLFETNSSNISLRNNcMPSNHGFGSIAIVTFSPEYSFRFNDNSINEFIQ DPALTLMHELIHSLHGLYGAhGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 53 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSrHILLPNVIIMG AEPDLFaahSSNISLRNNYMPaNHGFGSIAIVTFSPEYSFRFNDNSINEFIQD PALTLMHELIHSLHGLYGAKGITTTCtITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGrhK YFKLSNLLNDSIYNISEGYNINNLKVNFRGQNANLNPRIIKPITGRGLVK KIIRF | 54 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFaahSSNISLRNNYMPaNHGFGSIAIVTFSPEYSFRFNDNSINEFIQD PALTLMHELIHSLHGLYGAKGITTTCtITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGrhK YFKLSNLLNDSIYNISEGYNINNLKVNFRGQNANLNPRIIKPITGRG*VKK IIRF | 55 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFaahSSNISLRNNYMPaNHGFGSIAIVTFSPEYSFRFNDNSINEFIQD PALTLMHELIHSLHGLYGAKGITTTCtITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGrhK YFKLSNLLNDSIYNISEGYNINNLKVNFRGQNANLNPRIIKPITGRGLVK KIIRF | 56 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFaahSSNISLRNNYMPaNHGFGSIAIVTFSPEYSFRFNDNSINEFIQD PALTLMHELIHSLHGLYGAKGITTTCtITQQQNPLITNRKGINIEEFLTFGG NDLNIITVAQYNDIYTNLLNDYRKIASKLSKVQVSNPQLNPYKDIFQEK YGLDKnASGIYSVNINKFDDILKKLYSFTEFDLATKFQVKCRETYIGrhKY FKLSNLLNDSIYNISEGYNINNLKVNFRGQNtNLNPRIIKPITGRGLVKKII RF | 57 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFcswSSNISLRNNYMPSNHGFGSIAIVTFSPEYSFRFNDNSINEFIQ DPALTLMHELIHSLHGLYGAlGITTTrIITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGQY KsFKLSNLLNDSIYNISEGYNINNLKVNFRGQNANLNPRIIKPITGRGLVK KIIRF | 58 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFcTwSSNISLRNNYrPSNHGFGSIAIVTFSPEYSFRFNDNSINEFIQD PALTLMHELIHSLHGLYGAlGITTTrIITQQQNPLITNRKGINIEEFLTFGGN DLNIITVAQYNDIYTNLLNDYRKIASKLSKVQVSNPQLNPYKDIFQEKY GLDKDASGIYSVNINKFDDILKKLYSFTEFDLATKFQVKCRETYIGQYKc FKLSNLLNDSIYNISEGYNINNLKVNFRGQNANLNPRIIKPITGRGLVKKI IRF | 59 |

TABLE 28-continued

| Sequence | SEQ ID NO |
|---|---|
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFrTySSNISLRNNYMPSNHGFGSIAIVTFSPEYSFRFNDkSmNEFIQ DPALTLMHELIHSLHGLYGAhGITTTCIITQQQNPLITNRKGINIEEFLTFG GNDLNIITVAQYNDIYTNLLNDYRKIASKLSKVQVSNPQLNPYKDIFQE KYGLDeDASGIYSVNINKFDDILKKLYSFTEFDLATKFQVKCRETYIGQY KYFKLSNLLNDSIYNISEGYNINNLKVNFRGQNANLNPRIIKPITGRGLV KKIIRF | 60 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFcswSSNISLRNNYMPSNHGFGSIAIVTFSPEYSFRFNDNSINEFIQ DPALTLMHELIHSLHGLYGAlGITTTrIITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGQY KcFKLSNLLNDSIYNISEGYNINNLKVNFRGQNANLNPRIIKPITGRGLVK KIIRF | 61 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFcTwSSNISLRNNYMPSNHGFGSIAIVTFSPEYSFRFNDNSINEFIQ DPALTLMHELIHSLHGLYGAlGITTTrIITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGQY KcFKLSNLLNDSIYNISEGYNINNLKVNFRGQNANLNPRIIKPITGRGLVK KIIRF | 62 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFcswSSNISLRNNYMPSNHGFGSIAIVTFSPEYSFRFNDNSINEFIQ DPALTLMHELIHSLHGLYGAlGITTTrIITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGQY KYFKLSNLLNDSIYNISEGYNINNLKVNFRGQNANLNPRIIKPITGRGLV KKIIRF | 63 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFsTwSSNISLRNNYMPSNHGFGSIAIVTFSPEYSFRFNDkSmNEFIQ DPALTLMHELIHSLHGLYGAhGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 64 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFETNSSNISLRNNYMPSNHGFGSIAIVTFSPEYSFRFNDNSINEFIQ DPALTLMHELIHSLHGLYGAlGITTTCtITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 65 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFETNSSNISLRNNYMPSNHGFGSIAIVTFSPEYSFRFNDNSINEFIQ DPALTLMHELIHSLHGLYGAlGITTTCtITQQQNPLITNRKGINIEEFLTFG GNDLNIITVtQYNDIYTNLLNDYRKIASKLSKVQVSNPQLNPYKDIFQEK YGLDKDASGIYSVNINKFDDILKKLYSFTEFDLATKFQVKCRETYIGQY KYFKLSNLLNDSIYNISEGYNINNLKVNFRGQNANLNPRIIKPITGRGLV KKIIRF | 66 |

TABLE 28-continued

| Sequence | SEQ ID NO |
|---|---|
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSdGSQHILLPNVIIMG AEPDLFETNSSNISLRNNYMPSNHGFGSIAIVTFSPEYSFRFNDNSINEFIQ DPALTLMHELIHSLHGLYGAlGITTTCtITQQQNPLITNRKGINIEEFLTFG GNDLNIITVAQYNDIYTNLLNDYRKIASKLSKVQVSNPQLNPYKDIFQE KYGLDKDASGIYSVNINKFDDILnKLYSFTEFDLATKFQVKCRETYIGQY KYFKLSNLLNDSIYNISEGYNINNLKVNFRGQNANLNPRIIKPITGRGLV KKIIRF | 67 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFrNGSQHILLPNVIIMG AEPDLFETNSSNISLRNNYMPSNHGFGSIAIVTFSPEYSFRFNDNSINEFIQ DPALTLMHELIHSLHGLYGAlGITTTCtITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGQ YKYFKLSNLLNDSIYNISEGYNINNLKVNFRGQNANLNPRIIKPITGRGL VKKIIRF | 68 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AgPDLFEaNSSNISLRNNYMPSNHGFGSIAIVTFSPEYSFRFNDNSINEFIQ DPALTLMHELIHSLHGLYGAhGITTTrIITQQQNPLITNRKGINIEEFLTFG GNDLNIvTVAQYNDIYTNLLNDYRKIASKLSKVQVSNPQLNPYKDIFQE KYGLDKDASGIYSVNINKFDDILKKLYSFTEFDLATKFQVKCRETYIGQ YKcFKLSNLLNDSIYNISEGYNINNLKVNFRGQNANLNPRIIKPITGRGLV KKIIRF | 69 |
| MPKINSFNYNDPVNDRTILYIrPGGCQkFYKSFNIMKNIWIIPERNVIGTTP QDFHPPTSLKNGDSSYYDPNYLQSDEEKDRFLKIVTKIFNRINNNLSGGI LLEELSKANPYLGNDNTPDNQFHIGDASAVEIKFSNGSQHILLPNVIIMG AgPDLFETNSrNISLRNNYMPSNHGFGSIAIVTFSPEYSFRFNDNSINEFIQ DPALTLMHELIHSLHGLYGAhGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYaGQ YKcFKLSNLLNDSIYNISEGYNINNLKVNFRGQNANLNPRIIKPITGRGLV KKIIRF | 70 |
| MPKINSFNYNDPVNDRTILYIrPGGCQkFYKSFNIMKNIWIIPERNVIGTTP QDFHPPTSLKNGDSSYYDPNYLQSDEEKDRFLKIVTKIFNRINNNLSGGI LLEELSKANPYLGNDNTPDNQFHIGDASAVEIKFSNGSQHILLPNVIIMG AgPDLFETNSrNISLRNNYMPSNHGFGSIAIVTFSPEYSFRFNDNSINEFIQ DPALTLMHELIHSLHGLYGAhGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYaGQ YKwFKLSNLLNDSIYNISEGYNINNLKVNFRGQNANLNPRIIKPITGRGL VKKIIRF | 71 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AgPDLFEaNSSNISLRNNYMPSNHGFGSIAIVTFSPEYSFRFNDNSINEFIQ DPALTLMHELIHSLHGLYGAhGITTTrIITQQQNPLITNRKGINIEEFLTFG GNDLNIvTVAQYNDIYTNLLNDYRKIASKLSKVQVSNPQLNPYKDIFQE KYGLDKDASGIYSVNINKFDDILKKLYSFTEFDLATKFQVKCRETYIGQ YKcFKLSNLLNDSIYNISEGYNINNLKVNFRGQNANLNPRIIKPsTGRGLV KKIIRF | 72 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AgPDLFETNaSNISLRNNYrPSNHGFGSIAIVTFSPEYSFRFNDNSINEFIQD PALTLMHELIHSLHGLYGAhGITTTCIITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGQY KYFKLSNLLNDSIYNISEGYNINNLKVNFRGQNANLNPRIIKPITGRGLV KKIIRF | 73 |

TABLE 28-continued

| Sequence | SEQ ID NO |
|---|---|
| MPKINSFNYNDPVNDRTILYIKPGGCQkFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFaahSSNISLRNNYMPaNHGFGSIAIVTFSPEYSFRFNDNSINEFIQD PALTLMHELIHSLHGLYGAKGITTTCIITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGrhK YFKLSNLLNDSIYNISEGYNINNLKVNFRGQNANLNPRIIKPITGRG*VKK IIRF | 74 |
| MPKINSFNYNDPVNDRTILYIKPGGCQkFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGgASAVEIKFSNGSQHILLPNVIIMG AEPDLFaahSSNISLRNNYMPaNHGFGSIAIVTFSPEYSFRFNDNSINEFIQD PALTLMHELIHSLHGLYGAKGITTTCIITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGrhK YFKLSNLLNDSIYNISEGYNINNLKVNFRGQNANLNPRIIKPITGRG*VKK IIRF | 75 |
| MPKINSFNYNDPVNDRTILYmKPGGCQkFYKSFNIMKNIWIIPERNVIGT TPQDFHPPTSLKNGDSSYYDPNYLQSDEEKDRFLKIVTKIFNRINNNLSG GILLEELSKANPYLGNDNTPDNQFHIGDASAVEIKFSNGSQHILLPNVIIM GAEPDLFaahSSNISLRNNYMPaNHGFGSIAIVTFSPEYSFRFNDNSINEFIQ DPALTLMHELIHSLHGLYGAKGITTTCIITQQQNPLITNRKGINIEEFLTFG GNDLNIITVAQYNDIYTNLLNDYRKIASKLSKVQVSNPQLNPYKDIFQE KYGLDKDASGIYSVNINKFDDILKKLYSFTEFDLATKFQVKCRETYIGrh KYFKLSNLLNDSIYNISEGYNINNLKVNFRGQNANLNPRIIKPITGRG*VK KIIRF | 76 |
| MPKINSFNYNDPVNDRTILYIKPGGCQkFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFaahSrNISLRNNYMPaNHGFGSIAIVTFSPEYSFRFNDNSINEFIQD PALTLMHELIHSLHGLYGAKGITTTCIITQQQNPLITNRrGINIEEFLTFGG NDLNIITgAQYNDIYTNLLNDYRKIASKLSKVQVSNPQLNPYKDIFQEKY GLDKDASGIYSVNINKFDDILKKLYSFTEFDLATKFQVKCRETYIGrhKY FKLSNLLNDSIYNISEGYNINNLKVNFRGQNANLNPRIIKPITGRGLVKKI IRF | 77 |
| MPKINSFNYNDPVNDRTILYIKPGGChEFYKSFNIMKNIWIIPERNVIGTT PQDFHPPTSLKNGDSSYYDPNYLQSDEEKDRFLKIVTKIFNRINNNLaGsI LLEELSKANPYLGNDNTPDNQFHIGDASAVEIKFSNGSQHILLPNVIIMG AEPDLFlTyqSNISLRNNYMPSNHGFGSIAIVTFSPEYSFRFNDNSINEFIQD PALTLMHELIHSLHGLYGAKGITTTCtITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGrhK YFKLSNLLNDSIYNISEGYNINNLKVNFRGQNANLNPRIIKPITGRGLVK KIIRF | 78 |
| MPKINSFNYNDPVNDRTILYIKPGGCQkFYKSFNIMKNIWIIPERNVIGTT PQDFHPPTSLKNGDSSYYDPNYLQSDEEKDRFLKIVTKIFNRINNNLSGG ILLEELSKANPYLGNDNkPDNQFHIGDASAVEIKFSNGSQHILLPNVIIMG AEPDLFaahSSNISLRNNYMPaNHGFGSIAIVTFSPEYSFRFNDNSINEFIQD PALTLMHELIHSLHGLYGAKGITTTCIITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGrhK YFKLSNLLNDSIYNISEGYNINNLKVNFRGQNANLNPRIIKPITGRG*VKK IIRF | 79 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFcTwSSNISLRNNYMPSNHGFGSIAIVTFSPEYSFRFNDNSINEFIQ DPALTLMHELIHSLHGLYGAlGITTTrIITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGrhK YFKLSNLLNDSIYNISEGYNINNLKVNFRGQNANLNPRIIKPITGRGLVK KIIRF | 80 |

TABLE 28-continued

| Sequence | SEQ ID NO |
| --- | --- |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFcswSSNISLRNNYMPSNHGFGSIAIVTFSPEYSFRFNDNSmNEFIQ DPALTLMHELIHSLHGLYGAlGITTTrIITQQQNPLITNRKGINIEEFLTFGG NDLNIITgAQYNDIYTNLLNDYRKIASKLSKVQVSNPQLNPYKDIFQEKY GLDKDASGIYSVNINKFDDILKKLYSFTEFDLATKFQVKCRETYIGrYKcF KLSNLLNDSIYNISEGYNINNLKVNFRGQNANLNPRIIKPITGRGLVKKII RF | 81 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFcswSSNISLRNNYMPSNHGFGSIAIVTFSPEYSFRFNDNSINEFIQ DPALTLMHELIHSLHGLYGAlGITTTrIITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGQY KcFKLSNLLNDSIYNISEGYNINNLKVNFRGQNANLNPRIIKPITGRGLVK KIIRF | 82 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFcTwSSNISLRNNYMPSNHGFGSIAIVTFSPEYSFRFNDNSINEFIQ DPALTLMHELIHSLHGLYGslGITTTrIITQQQNPLITNRrGINIEEFLTFGGN DLNIITVAQYNDIYTNLLNDYRKIASKLSKVQVSNPQLNPYKDIFQEKY GLDKDASGIYSVNINKFDDILKKLYSFTEFDLATKFQVKCRETYIGrhKY FKLSNLLNDSIYNISEGYNINNLKVNFRGQNANLNPRIIKPITGRGLVKKI IRF | 83 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFcswSSNISLRNNYMPSNHGFGSIAIVTFSPEYSFRFNDNSmNEFIQ DPALTLMHELIHSLHGLYGAlGITTTrIITQQQNPLITNRKGINIEEFLTFGG NDLNIITgAQYNDIYTNLLNDYRKIASKLSKVQVSNPQLNPYKDIFQEKY GLDKDsSGIYSVNINKFDDILKKLYSFTEFDLATKFQVKCRETYIGrYKcF KLSNLLNDSIYNISEGYNINNLKVNFRGQNANLNPRIIKPITGRGLVKKII RF | 84 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFcswSSNISLRNNYMPSNHGFGSIAIVTFSPEYSFRFNDNSINEFIQ DPALTLMHELIHSLHGLYGAlGITTTrIITQQQNPLITNRKGINIEEFLTFGG NDLNIITVAQYNDIYTNLLNDYRKIASKLSKVQVSNPQLNPYKDIFQEK YGLDKDASGIYSVNINKFDDILKKLYSFTEFDLATKFQVKCRETYIGQY KcFKLSNLLNDSIYNISEGYNINNLKVNFRGQNANLNPRIIKPITGRG*VK KIIRF | 85 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFcTwSSNISLRNNYMPSNHGFGSIAIVTFSPEYSFRFNDNSINEFIQ DPALTLMHELIHSLHGLYGAlGITTTrIITQQQNPLITNRKGvNIEEFLTFG GNDLNIITgAQYNDIYTNLLNDYRKIASKLSKVQVSNPQLNPYKDIFQEK YGLDKDASGIYSVNINKFDDILKKLYSFTEFDLATKFQVKCRETYvGQY KcFKLSNLLNDSIYNISEGYNINNLKVNFRGQNANLNPRIIKPITGRGLVK KIIRF | 86 |
| MPKINSFNYNDPVNDRTILYIKPGGCQEFYKSFNIMKNIWIIPERNVIGTT PQDFHPPTSLKNGDSSYYDPNYLQSDEEKDRFLKIVTKIFNRINNNLSGG ILLEELSKANPYLGNDNTPDNQFHIGDASAVEIKFSNGSQHILLPNVIIMG AEPDLFcswSSNISLRNNYMPSNHGFGSIAIVTFSPEYSFRFNDNSmNEFIQ DPALTLMHELIHSLHGLYGAlGITTTrIITQQQNPLITNRKGINIEEFLTFGG NDLNIITgAQYNDIYTNLLNDYRKIASKLSKVQVSNPQLNPYKDIFQEKY GLDKDASGIYSVNINKFDDILKKLYSFTEFDLATKFQVKCRETYIGQYKc FKLSNLLNDSIYNISEGYNINNLKVNFRGQNANLNPRIIKPITGRGLVKKI IRF | 87 |

TABLE 28-continued

| Sequence | SEQ ID NO |
|---|---|
| MPKINSFNYNDPVNDRTILYIKPGGCQkFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAlGITTTCtITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGrh<br>KYFKLSNLLNDSIYNISEGYNINNLKVNFRGQNANLNPRIIKPITGRGLV<br>KKIIRF | 88 |
| MPKINgFNYNDPVNDRTILYIKPGGCQkFYKSFNIMKNIWIIPERNVIGTT<br>PQDFHPPTSLKNGDSSYYDPNYLQSDEEKDRFLKIVTKIFNRINNNLSGG<br>ILLEELSKANPYLGNDNTPDNQFHIGDASAVEIKFSNGSQHILLPNVIIMG<br>AEPDLFETNSSNISLRNNYMPSNHGFGSIAIVTFSPEYSFRFNDNSINEFIQ<br>DPALTLMHELIHSLHGLYGAlGITTTCtITQQQNPLITNRKGINIEEFLTFG<br>GNDLNIITVAQYNDIYTNLLNDYRKIASKLSKVQVSNPQLNPYKDIFQE<br>KYGLDKDASGIYSVNINKFDDILKKLYSFTEFDLATKFQVKCRETYIGrh<br>KYFKLSNLLNDSIYNISEGYNINNLKVNFRGQNANLNPRIIKPITGRGLV<br>KKIIRF | 89 |
| MPKINSFNYNDPVNDRTILYIKPGGChEFYKSFNIMKNIWIIPERNVIGTT<br>PQDFHPPTSLKNGDSSYYDPNYLQSDEEKDRFLKIVTKIFNRINNNLaGsI<br>LLEELSKANPYLGNDNTPDNQFHIGDASAVEIKFSNGSQHILLPNVIIMG<br>AEPDLFlTyqSNISLRNNYkPSNHGFGSIAIVTFSPEYSFRFNDNSINEFIQD<br>PALTLMHELIHSLHGLYGAKGITTTCtITQQQNPLITNRKGINIEEFLTFGG<br>NDLNIITVAQYNDIYTNLLNDYRKIASKLSKVQVSNPQLNPYKDmFQEK<br>YGLDKDASGIYSVNINKFDDILKKLYSFTEFDLATKFQVKCRETYIGrhK<br>YFKLSNLLNDSIYNISEGYNINNLKVNFRGQNANLNPRIIKPITGRGLVK<br>KIIRF | 90 |
| MPKINSFNYNDPVNDRTILYIKPGGChEFYKSFNIMKNIWIIPERNVIGTT<br>PQDFHPPTSLKNGDSSYYDPNYLQSDEEKDRFLKIVTKIFNRINNNLaGsI<br>LLEELSKANPYLGNDNTPDNQFHIGDASAVEIKFSNGSQHILLPNVIIMG<br>AEPDLFlTyqSNISLRNNYkPSNHGFGSIAIVTFSPEYSFRFNDNSINEFIQD<br>PALTLMHELIHSLHGLYGAKGITTTCtITQQQNPLITNRKGINIEEFLTFGG<br>NDLNIITVAQYNDIYTNLLNDYRKIASKLSKVQVSNPQLNPYKDIFQEK<br>YGLDKDASGIYSVNINKFDDILKKLYSFTEFDLATKFQVKCRETYIGrhK<br>YFKLSNLLNDSIYNISEGYNINNLKVNFRGQNANLNPRIIKPITGRGLVK<br>KIIRF | 91 |
| MPKINSFNYNDPVNDRTILYIKPGGChEFYKSFNIMKNIWIIPERNVIGTT<br>PQDFHPPTSLKNGDSSYYDPNYLQSDEEKDRFLKIVTKIFNRINNNLaGsI<br>LLEELSKANPYLGNDNTPDNQFHIGDASAgEIKFSNGSQHILLPNVIIMG<br>AEPDLFlTyqSNISLRNNYkPSNHGFGSIAIVTFSPEYSFRFNDNSINEFIQD<br>PALTLMHELIHSLHGLYGAKGITTTCtITQQQNPLITNRKGINIEEFLTFGG<br>NDLNIITVAQYNDIYTNLLNDYRKIASKLSKVQVSNPQLNPYKDIFQEK<br>YGLDKDASGIYSVNINKFDDILKKLYSFTEFDLATKFQVKCRETYIGrhK<br>YFKLSNLLNDSIYNISEGYNINNLKVNFRGQNANLNPRIIKPITGRGLVK<br>KIIRF | 92 |
| MPKINSFNYNDPVNDRTILYIKPGGChEFYKSFNIMKNIWIIPERNVIGTT<br>PyDFHPPTSLKNGDSSYYDPNYLQSDEEKDRFLKIVTKIFNRINNNLaGsI<br>LLEELSKANPYLGNDNTPDNQFHIGDASAVEIKFSNGSQHILLPNVIIMG<br>AEPDLFlTyqSNISLRNNYMPSNHGFGSIAIVTFSPEYSFRFNDNSINEFIQD<br>PALTLMHELIHSLHGLYGAKGITTTCtITQQQNPLITNRKGINIEEFLTFGG<br>NDLNIITVAQYNDIYTNLLNDYRKIASKLSKVQVSNPQLNPYKDIFQEK<br>YGLDKDASGIYSVNINKFDDILKKLYSFTEFDLATKFQVKCRETYIGrhK<br>YFKLSNLLNDSIYNISEGYNINNLKVNFRGQNANLNPRIIKPITGRGLVK<br>KIIRF | 93 |
| MPKINSFNYNDPVNDRTILYIKPGGChEFYKSFNIMKNIWIIPERNVIGTT<br>PQDFHPPTSLKNGDSSYYDPNYLQSDEEKDRFLKIVTKIFNRINNNLaGsI<br>LLEELSKANPYLGNDdTPDNQFHIGDASAVEIKFSNGSQHILLPNVIIMG<br>AEPDLFlTyqrNISLRNNYkPSNHGFGSIAIVTFSPEYSFRFNDNSINEFIQDP<br>ALTLMHELIHSLHGLYGAKGITTTCtITQQQNPLITNRKGINIEEFLTFGG<br>NDLNIITVAQYNDIYTNLLNDYRKIASKLSKVQVSNPQLNPYKDIFQEK<br>YGLDKDASGIYSVNINKFDDILKKLYSFTEFDLATKFQVKCRETYIGrYK<br>pFKLSNLLNDSIYNISEGYNINNLKVNFRGQNANLNPRIIKPITGRGLVKK<br>IIRF | 94 |

TABLE 28-continued

| Sequence | SEQ ID NO |
|---|---|
| MPKINSFNYNDPVNDRTILYIKPGGyhEFYKSFNIMKNIWIIPERNVIGTTP<br>QDFHPPTSLKNGDSShYDPNYLQSDEEKDRFLKIVTKIFNRINNNLaGsIL<br>LEELSKANPYLGNDdTPDNQFHIGDASAVEIKFSNGSQHILLPNVIIMGA<br>EPDLFlTyqrNISLRNNYkPSNHGFGSIAIVTFSPEYSFRFNDNSINEFIQDPA<br>LTLMHELIHSLHGLYGAKGITTTCtITQQQsPLITNRKGINIEEFLTFGGND<br>LNIITVAQYNDIYTNLLNDYRKIASKLSKVQVSNPQLNPYKDIFQEKYGL<br>DKDASGIYSVNINKFDDILKKLYSFTEFDLATKFQVKCRETYIGrYKhFK<br>LSNLLNDSIYNISEGYNINNLKVNFRGQNANLNPRIIKPITGRGLVKKIIRF | 95 |
| MPKINSFNYNDPVNDRTILYIKPGGChEFYKSFNIMKNIWIIPERNVIGTT<br>PQDFHPPTSLKNGDSSYYDPNYLQSDEEKDRFLKIVTKIFNRINNNLaGsI<br>LLEELSKANPYLGNDdTPDNQFHIGDASAVEIKFSNGSQHILLPNVIIMG<br>AEPDLFlTyqrNISLRNNYkPSNHGFGSIAIVTFSPEYSFRFNDNSINEFIQDP<br>ALTLMHELIHSLHGLYGAKGITTTCtITQQQNPLITNRKGINIEEFLTFGG<br>NDLNIITVAQYNDIYTNLLNDYRKIASKLSKVQVSNPQLNPYKDIFQEK<br>YGLDKDASGIYSVNINKFDDILKKLYSFTEFDLATKFQVKCRETYIGrYK<br>pFKLSNLLNDSIYNISEGYNINNLKVNFRGQNANLNPRIIKPITGRGLVKK<br>ItRF | 96 |
| MPKINSFNYNDPVNDRTILYIKPGGChEFYKSFNIMKNIWIIPERNVIGTT<br>PQDFHPPTSLKNGDSSYYDPNYLQSDEEKDRFLKIVTKIFNRINNNLtGsI<br>LLEELSKANPYLGNDdTPDNQFHIGDASAVEIKFSNGSQHILLPNVIIMG<br>AEPDLFlTyqrNISLRNNYkPSNHGFGSIAIVTFSPEYSFRFNDNSINEFIQDP<br>ALTLMHELIHSLHGLYGAKGITTTCtITQQQNPLITNRKGINIEEFLTFGG<br>NDLNIITVAQYNDIYTNLLNDYRKIASKLSKVQVSNPQLNPYKDIFQEK<br>YGLDKDASGIYSVNINKFDDILKKLYSFTEFDLATKFQVKCRETYIGrYK<br>pFKLSNLLNDSIYNISEGYNINNLKVNFRGQNANLNPRIIKPITGRG*VKK<br>IIRF | 97 |
| MPKINSFNYNDPVNDRTILYIKPGGyhEFYKSFNIMKNIWIIPERNVIGTTP<br>QDFHPPTSLKNGDSSYYDPNYLQSDEEKDRFLKIVTKIFNRINNNLaGsIL<br>LEELSKANPYLGNDdTPDNQFHIGDASAVEIKFSNGSQHILLPNVIIMGA<br>EPDLFlTyqrNISLRNNYkPSNHGFGSIAIVTFSPEYSFRFNDNSINEFIQDPA<br>LTLMHELIHSLHGLYGAKGITTTCtITQQQNPLITNRKGINIEEFLTFGGN<br>DLNIITVAQYNDIYTNLLNDYRKIASKLSKVQVSNPQLNPYKDIFQEKY<br>GLDKDASGIYSVNINKFDDILKKLYSFTEFDLATKFQVKCRETYIGrYKh<br>FKLSNLLNDSIYNISEGYNINNLKVNFRGQNANLNPRIIKPITGRGLVKKI<br>IRF | 98 |
| MPKINSFNYNDPVNDRTILYIKPGGChEFYKSFNIMKNIWIIPERNVIGTT<br>PQDFHPPTSLKNGDSSYYDPNYLQSDEEKDRFLKIVTKIFNRINNNLaGsI<br>LLEELSKANPYLGNDdTPDNQFHIGDASAVEIKFSNGSQHILLPNVIIMG<br>AEPDLFlTyqrNISLRNNYkPSNHGFGSIAIVTFSPEYSFRFNDNSINEFIQDP<br>ALTLMHELIHSLHGLYGAKGITTTCtITQQQNPLITNRKGINIEEFLTFGG<br>NDLNIITVAQYNDIYTNLLNDYRKIASKLSKVQVSNPrLNPYKDIFQEKY<br>GLDKDASGIYSVNINKFDDILKKLYSFTEFDLATKFQVKCRETYIGrYKp<br>FKLSNLLNDSIYNISEGYNINNLKVNFRGQNANLNPRIIKPITGRGLVKKI<br>IRF | 99 |
| MPKINSFNYNDPVNDRTILYIKPGGChEFYKSFNIMKNIWIIPERNVIGTT<br>PQDFHPPTSLKNGDSSYYDPNYLQSDEEKDRFLKIVTKIFNRINNNLaGsI<br>LLEELSKANPYLGNDdTPDNQFHIGDASAVEIKFSNGSQHILLPNVIIMG<br>AEPDLFlTyqrNISLRNNYkPSNHGFGSIAIVTFSPEYSFRFNDNSINEFIQDP<br>ALTLMHELIHSLHGLYGAKGITTTCtITQQQNPLITNRKGINIEEFLTFGG<br>NDLNIITVAQYNDIYTNLLNDYRKIASKLSKVQVSNPQLNPYKDIFQEK<br>YGLDKDASGIYSVNINKFDDILKKLYSFTEFDLATKFQVKCRETYIGrYK<br>hFKLSNLLNDSIYNISEGYNINNLKVNFRGQNANLNPRIIKPITGRGLVKK<br>IIRF | 100 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGNLAVNN<br>RGQNIKLNlnIIDSIPDKGLVEKIVKF | 101 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGNLAVNN<br>RGQNIKLNlKIIDSIPDKGLVEKIVKF | 102 |

TABLE 28-continued

| Sequence | SEQ ID NO |
|---|---|
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSNDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFLKVPNLLDDDIYTVSEGFNIGNLAVNN RGQNIKLNlKIIDSIPDKGLVEKIVKF | 103 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVrSSIIL NLLVLGAGPDIFENEsySYPVRKLMDSGGVYDPSNDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFLKVPNLLDDDIYTVSEGFNIGhLAVNN RGQNIKLNlKIIDSIPDKGLVEKIVKF | 104 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISdAKPYLGNEHTPINEFHPVTRTTSVNIKSSTNVrSSIIL NLLVLGAGPDIFENySYPVRKLMDSGGVYDPSNDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFLKVPNLLDDDIYTVSEGFNIGNLAVNN RGQNIKLNlKIIDSIPDKGLVEKIVKF | 105 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSNDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFLKVPNLLDDDIYTVSEGFNIGhLAVNN RGQNIKLNlKIIDSIPDKGLVkKIVKF | 106 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSNDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYgF TEIDLANKlKVKCRNTYFIKhGFLKVPdLLDDDIYTVSEGFNIGNLAVNN RGQNIKLNlKIIDSIPDKGLVEKIVKF | 107 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSNDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYgF TEIDLANKlKVKCRNTYFIKhGFLKVPdLLDDDIYTVSEGFNIGhLAVNNR GQNIKLNlKIIDSIPDKawlrKs*KF | 108 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSNDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYgF TEIDLANKlKVKCRNTYFIKhGFLKVPNLLDDDIYTVSEGFNIGNLAVNN RGQNIKLNlKIIDSIPDKawlrKs*KF | 109 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSsDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYgF | 110 |

TABLE 28-continued

| Sequence | SEQ ID NO |
|---|---|
| TEIDLANKlKVKCRNTYFIKhGFLKVPNLLDDDIYTVSEGFNIGNLAVNN<br>RGQNIKLNlKIIDSIPDKawlrKs*KF | |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYgF<br>TEIDLANKlKVKCRNTYFIKhGFLKVPNLLDDDIYTVSEGFNIGhLAVNN<br>RGQNIKLNlKIIDSIPDKawlrKs*KF | 111 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMaSGGVYDPSkDGFGSINIVTFSPEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGNLAVNNR<br>GQNIKLNlKIIDSIPDKGLVEKIVKF | 112 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGhLAVNN<br>RGQNIKLNlKIIDSIPDKGLVkKIVKF | 113 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkaGFGSINIVTFSPEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGhLAVNNR<br>GQNIKLNlKIIDSIPDKGLVkKIVKF | 114 |
| MPVVINSFNYNDPVNDDTILYMQIPYEEKSKKYYKAFEIMRNVWIIPER<br>NTIGTDPSDFDPPASLENGSSAYYDPNYLTTDvEKDRYLKTTIKLFKRINS<br>NPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGhLAVNN<br>RGQNIKLNlKIIDSIPDKvLVkKIVKF | 115 |
| MPVVINSFNYNDPVNDDTILYMQIPYEEKSKKYYKAFEIMRNVWIIPER<br>NTIGTDPSDFDPPASLENGSSAYYDPNYLTTDvEKDRYLKTTIKLFKRINS<br>NPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGhLAVNN<br>RGQNIKLNlKIIDSIPDKGLVkKIVKF | 116 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISYAKPYLGNEHTPINEFHPVTRTTSVNIKSSTNVKSSIIL<br>NLLVLGAGPDIFgNySYPVRKLMDSGGVYDPSkDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGhLAVNN<br>RGQNIKLNlKIIDSIPDKGLVkKIVKF | 117 |
| MPVVINSFNYNDPVNDDTILYMQIPYEEKSKKYYKAFEIMhNVWIIPER<br>NTIGTDPSDFePPASLENGSSAYYDPNYLTTDAEKDRYLKTTIKLFKRINS<br>NPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYEY<br>TFNDISGGYNSSTESFIADPAISLAHELIHALHGLYGAlGVTYKETIKVKQ | 118 |

TABLE 28-continued

| Sequence | SEQ ID NO |
|---|---|
| APLMIAEKPIRLEEFLTFGGQDLNIITSAMKEKIYNNLLANYEKIATRLSR<br>VNSAPPEYDINEYKDYFQWKYGLDKNADGSYTVNEtKFNEIYKKLYSFT<br>EIDLANKlKVKCRNTYFIKhGFLKVPNLLDDDIYTVSEGFNIGhLAVNNR<br>GQNIKLNlKIIDSIPDKGLVkKIVKF | |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDvYTVSEGFNIGhLAVNN<br>RGQNIKLNlKIIDSIPDKGLVkKIVKF | 119 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLiLGAGPDIFENySYPVRKLMDSGGVYDPSkDGFGSINIVTFSPEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGhLAVNNR<br>GQNIKLNleIIDSIPDKGLVkKIVKF | 120 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEIShAKPYLGNEHTPINEFHPVTRTTSVNIKSSTNVKSSIIL<br>NLLVLGAGPnIFgNySYPVRKLMDSGGVYDPSkDGFGSINIVTFSPEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGhLAVNNR<br>GQNIKLNlKIIDSIPDKGLVkKIVKF | 121 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGNLAVNN<br>RGQNIKLNlKIIDSIPDKawlrKs*KF | 122 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFEsySYPVRKLMDSGGVYDPSkDGFGSINIVTFSPEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGNLAVNNR<br>GQNIKLNlKIIDSIPDKawlrKs*KF | 123 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGhLAVNN<br>RGQNIKLNlKIIDSIPDKawlrKs*KF | 124 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFEsySYPVRKLMDSGGVYDPSkDGFGSINIVTFSPEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGNLAVNNR<br>GQNIKLNlKIIDSIPDKawlrKt*KF | 125 |
| MPVVINSFNYNDPVNDDTILYMQIPYEEKnKKYYKAFEIMRNVWIIPER<br>NTIGTDPSDFDPPASLdNGSSAYYDPNYLTTDAEKDRYLKTTIKLFKRIN<br>SNPAGEVLLQEISdAKPYLGNEHTPINEFHPVTRTTSVNIKSSTNVKSSIIL | 126 |

TABLE 28-continued

| Sequence | SEQ ID NO |
| --- | --- |
| NLLVLGAGPDIFENySYPVRKLMDSGGVYDPSkDGFGSINIVTFSPEYEY<br>TFNDISGGYNSSaESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGNLAVNN<br>RGQNIKLNlKIIDSIPDKawlrKs*KF | |
| MPVVINSFNYNDPVNDDTILYMQIPYEEKSKKYYKAFEIMRNVWIIPER<br>NTIGTDPSDFDPPASLdNGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMgSGGVYDPSkDGFGSINIVTFSPEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGNLAVNNR<br>GQNIKLNlKIIDSIPDKawlrKs*KF | 127 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYgF<br>TEIDLANKlKVKCRNTYFIKhGFLKVPNLLDDDIYTVSEGFNIGhLAVNN<br>RGQNIKLNlKIIDSIPDKawlrKs*KF | 128 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYgF<br>TEIDLANKlKVKCRNTYFIKhGFLKVPNLLDDDIYTVSEGFNIGNLAVNN<br>RGQNIKLNlKIIDSIPDKawlrKs*KF | 129 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISYAKPYLGNEHTPINEFHPVTRTTSVNIKSSTNVKSSIIL<br>NLLVLGAGPDIFENiYPVRKLMDSGGVYDPSkDGFGiINIVTFSPEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYgFT<br>EIDLANKlKVKCRNTYFIKhGFLKVPNLLDDDIYTVSEGFNIGNLAVNNR<br>GQNIKLNlKIIDSIPDKawlrKs*KF | 130 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISYAKPYLGNEHTPINEFHPVTRTTSVNIKSSTNVKSSIIL<br>NLLVLGAGPDIFENiYPVRKLMDSGGVYDPSNDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYgF<br>TEIDLANKlKVKCRNTYFIKhGFLKVPNLLDDDIYTVSEGFNIGhLAVNN<br>RGQNIKLNlKIIDSIPDKawlrKs*KF | 131 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISYAKPYLGNEHTPINEFHPVTRTTSVNIKSSTNVKSSIIL<br>NLLVLGAGPDIFENiYPVRKLMDSGGVYDPSNDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKlNEIYKKLYgF<br>TEIDLANKlKVKCRNTYFIKhGFLKVPNLLDDDIYTVSEGFNIGNLAVNN<br>RGQNIKLNlKIIDSIPDKawlrKs*KF | 132 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYEY<br>TFNDISGGYNSSTESFIADPAISLAHELIHALHGLYGAlGVTYKETIKVKQ | 133 |

TABLE 28-continued

| Sequence | SEQ ID NO |
| --- | --- |
| APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFLKVPNLLDDDIYTVSEGFNIGhLAVNN RGQNIKLNlKIIDSIPDKGLVkKIVKF | |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSkaGFGSINIVTFSPEYEYT FNDISGGYNSSTESFIADPAISLAHELIHALHGLYGAlGVTYKETIKVKQA PLMIAEKPIRLEEFLTFGGQDLNIITSAMKEKIYNNLLANhEKIATRLSRV NSAPPEYDINEYKDYFQWKYGLDKNADGSYTVNENKFNEIYKKLYSFT EIDLANKlKVKCRNTYFIKhGFLKVPNLLDDDIYTVSEGFNIGhLAVNNR GQNIKLNlKIIDSIPDKGLVkKIVKF | 134 |
| MPVVINSFNYNDPVNDDTILYMQIPYEEKSKKYYKAFEIMRNVWIIPER NTIGTDPSDFDPPASLENGSSAYYDPNYLTTDvEKDRYLKTTIKLFKRINS NPAGEVLLQEISYAKPYLGNEHTPINEFHPVTRTTSVNIKSSTNVKSSIIL NLLVLGAGPDIFENySYPVRKLMDSGGVYDPSkDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFLKVPNLLDDDIYTVSEGFNIGhLAVNN RGQNIKLNlKIIDSIPDKGLVkKIVKF | 135 |
| MPVVINSFNYNDPVNDDTILYMQIPYEEKSKKYYKAFEIMhNVWIIPER NTIGTDPSDFDPPASLENGSSAYYDPNYLTTDAEKDRYLKTTIKLFKRINS NPAGEVLLQEISYAKPYLGNEHTPINEFHPVTRTTSVNIKSSTNVKSSIIL NLLVLGAGPDIFENySYPVRKLMDSGGVYDPSkDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEnKDYFQWKYGLDKNADGSYTVNENKFrEIYKKLYSFT EIDLANKlKVKCRNTYFIKhGFLKVPNLLDDDIYTVSEGFNIGhLAVNNR GQNIKLNlKIIDSIPDKGLVkKIVKF | 136 |
| MPVVINSFNYNDPVNDDTILYMQIPYEEKSKKYYKAFEvMRNVWIIPER NTIGTDPSDFDPPASLENGSSAYYDPNYLTTDvEKDRYLKTTIKLFKRINS NPAGEVLLQEISYAKPYLGNEHTPINEFHPVTRTTSVNIKSSTNVKSSIIL NLLVLGAGPDIFENySYPVRKLMDSGGVYDPSkDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFLKVPNLLDDDIYTVSEGFNIGhLAVNN RGQNIKLNlKIIDSIPDKGLVkKIVKF | 137 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSkDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFvKhGFrKVPNLLDDDIYTVSEGFNIGhLAVNNR GQNIKLNlKIIDSIPDKGLVkKIVKF | 138 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPnIFEtytYPVRKLMDSGGVYDPSkDGFGSINIVTFSPEYEYTF NDISGGYNSSTESFIADPAISLAHELIHALHGLYGAlGVTYKETIKVKQAP LMIAEKPIRLEEFLTFGGQDLNIITSAMKEKIYNNLLANYEKIATRLSRVN SAPPEYDINEYKDYFQWKYGLDKNADGSYTVNENKFNEIYKKLYSFTEI DLANKlKVKCRNTYFIKhGFLKVPNLLDDDIYTVSEGFNIGhLAVNNRGQ NIKLNlKIIDSIPDKGLVkKIVKF | 139 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSkDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFrKVPNLLDDDIYTVSEGFNIGhLAVNNR GQNIKLNlKIIDSIPDKGLVkKIVKF | 140 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL | 141 |

TABLE 28-continued

| Sequence | SEQ ID NO |
|---|---|
| NLLVLGAGPDIFEsySYPVRKLMDSGGVYDPSkDGFGSINIVTFSPEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYsVNENKFNEIYKKLYSFT<br>EIDLAtKlKVKCRNTYFIKhGFrKVPNLLDDDIYTVSEGFNIGhLAVNNRG<br>QNIKLNlKIIDSIPDKGLVkKIVKF | |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENytYPVRKLMDSGGVYDPSkDGFGSINIVTFSPEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFrKVPNLLDDDIYTVSEGFNIGhLAVNNRG<br>QNIKLNlKIIDSIPDKGLVkKIVKF | 142 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENytYPVRKLMDSGGVYDPSkDGFGSINIVTFSPEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYsVNENKFNEIYKKLYSFT<br>EIDLANKlKVKCRNTYFIKhGFrKVPNLLDDDIYTVSEGFNIGhLAVNNRG<br>QNIKLNlKIIDSIPDKGLVkKIVKF | 143 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENytYPVRrLMDSGGVYDPSkDGFGSINIVTFSPEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFrKVPNLLDDDIYTVSEGFNIGhLAVNNRG<br>QNIKLNlKIIDSIPDKGLVkKIVKF | 144 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENytYPVRKLMDSGGVYDPSkDGFGSINIVTFSsEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFrKVPNLLDDDIYTVSEGFNIGhLAVNNRG<br>QNIKLNlKIIDSIPDKGLVkKIVKF | 145 |
| MPVVINSFNYNDPVNDDTILYMQIPYEEKSKKYYKAFEIMRNVWIIPER<br>NTIGTDPSDFDPPASLENGSSAYYDPNYLsTDAEKDRYLKTTIKLFKRINS<br>NPAGEVLLQEISYAKPYLGNEHTPINEFHPVTRTTSVNIKSSTNVKSSIIL<br>NLLVLGAGPDIFENytYPVRKLMDSGGVYDPSkDGFGSINIVTFSPEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFrKVPNLLDDDIYTVSEGFNIGhLAVNNRG<br>QNIKLNlKIIDSIPDKGLVkKIVKF | 146 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENytYPVRKLMDSGGVYDPSkDGFGSINIVTFSPEYEYT<br>FNDISGGYNSSTESFIADPAISLAHELIHALHGLYGAlGVTYKETIKVKQA<br>PLMIAEKPIRLEEFLTFGGQDLNIITSAMKEKIYNNLLsNYEKIATRLSRV<br>NSAPPEYDINEYKDYFQWKYGLDKNADGSYTVNENKFNEIYKKLYSFT<br>EIDLANKlKVKCRNTYFIKhGFrKVPNLLDDDIYTVSEGFNIGhLAVNNRG<br>QNIKLNlKIIDSIPDKGLVkKIVKF | 147 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPnIFENyiYPVRKLMDSGGVYDPSkDGFGSINIVTFSPEYEYT<br>FNDISGGYNSSTESFIADPAISLAHELIHALHGLYGAlGVTYKETIKVKQA | 148 |

TABLE 28-continued

| Sequence | SEQ ID NO |
|---|---|
| PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYSFT EIDLANKlKVKCRNTYFIKhGFLKVPNLLDDDIYTVSEGFNIGhLAVNNR GQNIKLNlKIIDSIPDKGLVkKIVKF | |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEaLLQEISYAKPYLGNEHTPINEFHPVTRTTSVNIKSSTNVKSSIIL NLLVLGAGPnIFENySYPVRKLMDSGGVYDPSkDGFGSINIVTFSPEYkYT FNDISGGYNSSTESFIADPAISLAHELIHALHGLYGAlGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYSFT EIDLANKlKVKCRNTYFIKhGFLKVPNLLDDDIYTVSEGFNIGhLAVNNR GQNIKLNlKIIDSIPDKGLVkKIVKF | 149 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEaLLQEISYAKPYLGNEHTPINEFHPVTRTTiVNIKSSTNVKSSIIL NLLVLGAGPnIFENySYPVRKLMDSGGVYDPSkDGFGSINIVTFSPEYkYT FNDISGGYNSSTESFIADPAISLAHELIHALHGLYGAlGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYSFT EIDLANKlKVKCRNTYFIKhGFLKVPNLLyDDIYTVSEGFNIGhLAVNNRG QNIKLNlKIIDSIPDKGLVkKIVKF | 150 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEaLLQEISYAKPYLGNEHTPINEFHPVTRTTSVNIKSSTNVKSSIIL NLLVLGAGPnIFENySYPVRKLMDSGGVYDPSkDGFGSINIVTFSPEYkYT FNDISGGYNSSTESFIADPAISLAHELIHALHGLYGAlGVTYKETIKVKQA PLMIAEKPIRLEEFLTFGGQDLNIITSAMeEKIYNNLLANYEKIATRLSRV NSAPPEYDINEYKDYFQWKYGLDKNADGSYTVNEtKFNEIYKKLYSFTE IDLANKlKVKCRNTYFIKhGFLKVPNLLDDDIYTVSEGFNIGhLAVNNRG QNIKLNlKIIDSIPDKGLVkKIVKF | 151 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEaLLQEISYAKPYLGNEHTPINEFHPVTRTTSVNIKSSTNVKSSIIL NLLVLGAGPnIFENySYPVRKLMDSGGVYDPSkDGFGSINIVTFSPEYkYT FNDISGGYNSSTESFIADPAISLAHELIHALHGLYGAlGVTYKETIKVKQA PLMIAEKPIRLEEFLTFGGQDLNIITSAMKEKIYNNLvANYEKIATRLSRV NSAPPEYDINEYKDYFQWKYGLDKNADGSYTVNENKFNEIYKKLYSFT EIDLANKlKVKCRNTYFIKhGFLKVPNLLDDDIYTVSEGFNIGhLAVNNR GQNIKLNlKIIDSIPDKGLVkKIVKF | 152 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEaLLQEISYAKPYLGNEHTPINEFHPVTRTTSVNIKSSTNVKSSIIL NLLVLGAGPnIFENySYPVRKLMDSGGVYDPSkDGFGSINIVTFSPEYkYT FNDISGGYNSSTESFIADPAISLAHELIHALHGLYGAlGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKnLYSFT EIDLANKlKVKCRNTYFIKhGFLKVPNLLDDDIYTVSEGFNIGhLAVNNR GQNIKLNlKIIDSIPDKGLVkKIVKF | 153 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSkDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSh VNSAPPEYDINEYKDYFQWKYGLDKNADGSYTVNENKFNEIYKKLYSF TEIDLANKlKVKCRNTYFIKhGFLKVPNLLDDDIYTVSEGFNIGhLAVNN RGQNIKLNlKIIDSIPDKGLVkKIVKF | 154 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNdHTPINEFHPVTRTTSVNIKSSTNVKSSIIL NLLVLGAGPnIFEtytYPVRKLMDSGGVYDPSkDGFGSINIVTFSPEYEYT NDISGGYNSSTESFIADPAISLAHELIHALHGLYGAlGVTYKETIKVKQAP LMIAEKPIRLEEFLTFGGQDLNIITSAMKEKIYNNLLANYEKIATRLSRVN SAPPEYDINEYKDYFQWKYGLDKNADGSYTVNENKFNEIYKKLYSFTEI DLANKlKVKCRNTYFIKhGFLKVPNLLDDDIYTVSEGFNIGhLAVNNRGQ NIKLNlKIIDSIPDKGLVkKIVKF | 155 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL | 156 |

TABLE 28-continued

| Sequence | SEQ ID NO |
|---|---|
| NLLVLGAGPDIFENySYPVRKLMDSGGVYDPSkDGFGSINIVTFSPEYgY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFrKVPNLLDDDIYTVSEGFNIGhLAVNNR<br>GQNIKLNlKIIDSIPDKGLVkKIVKF | |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPnIFEsyiYPVRKLMDSGGVYDPSkDGFGSINIVTFSPEYEYTF<br>NDISGGYNSSTESFIADPAISLAHELIHALHGLYGAlGVTYKETIKVKQAP<br>LMIAEKPIRLEEFLTFGGQDLNIITSAMKEKIYNNLLANYEKIATRLSRVN<br>SAPPEYDINEYKDYFQWKYGLDKNADGSYTVNENKFNEIYKKLYSFTEI<br>DLANKlKVKCRNTYFIKhGFLKVPNLLDDDIYTVSEGFNIGhLAVNNRGQ<br>NIKLNlKIIDSIPDKGLVkKIVKF | 157 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPnIFEtytYPVRKLMDSGGVYDPSkDGFGSINIVTFSPEYEYTF<br>NDISGGYNSSTESFIADPAISLAHELIHALHGLYGAlGVTYKETIKVKQAP<br>LMIAEKPIRLEEFLTFGGQDLNIITSAMKEKIYNNLLANYEKIATRLSRVN<br>SAPPEYDINEYKDYFQWKYGLDKNADGSYTVNENKFNEIYKKLYSFTEI<br>DLANKlKVKCRNTYFIKhGFLKVPNLLDDDIYTVSEGFNIGhLAVNNRGQ<br>NIKLNlKIIDSIPDKGLVkKIVKF | 158 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPnIFEtytYPVRKLMDSGGVYDPSkDGFGSINIVTFSPEYEYTF<br>NDISGGYNSSTESFIADPAISLAHELIHALHGLYGAlGVTYKETIKVKQAP<br>LMIAEKPIRLEEFLTFGGQDLNIITSAMKEKIYNNLLANYEKIATRLSRVN<br>SAPPEYDINEYKDYFQWKYGLDKNADGSYTVNENKFNEIYKKLYSFTEI<br>DLANKlKVKCRNTYFIKhGFrKVPNLLDDDIYTVSEGFNIGhLAVNNRGQ<br>NIKLNlKIIDSIPDKGLVkKIVKF | 159 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPnIFEtytYPVRrLMDSGGVYDPSkDGFGSINIVTFSPEYEYTF<br>NDISGGYNSSTESFIADPAISLAHELIHALHGLYGAlGVTYKETIKVKQAP<br>LMIAEKPIRLEEFLTFGGQDLNIITSAMKEKIYNNLLANYEKIATRLSRVN<br>SAPPEYDINEYKDYFQWKYGLDKNADGSYTVNENKFNEIYKKLYSFTEI<br>DLANKlKVKCRNTYFIKhGFrKVPNLLDDDIYTVnEGFNIGhLAVNNRGQ<br>NIKLNlKIIDSIPDKGLVkKIVKF | 160 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNkHTPINEFHPVTRTTSVNIKSSTNVKSSIIL<br>NLLVLGAGPnIFEtytYPVRKLMDSGGVYDPSkDGFGSINIVTFSPEYEYTF<br>NDISGGYNSSTESFIADPAISLAHELIHALHGLYGAlGVTYKETIKVKQAP<br>LMIAEKPIRLEEFLTFGGQDLNIITSAMKEKIYNNLLANYEKIATRLSRVN<br>SAPPEYDINEYKDYFQWKYGLDKNADGSYTVNENKFNEIYKKLYSFTEI<br>DLANKlKVKCRNTYFIKhGFrKVPNLLDDDIYTVSEGFNIGhLAVNNRGQ<br>NIKLNlKIIDSIPDKGLVkKIVKF | 161 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNkHTPINEFHPVTRTTSVNIKSSTNVKSSIIL<br>NLLVLGAGPnIFEtytYPVRKLMDSGGVYDPSkDGFGSINIVTFSPEYEYTF<br>NDISGGYNSSTESFIADPAISLAHELIHALHGLYGAlGVTYKETIKVKQAP<br>LMIAEKPIRLEEFLTFGGQeLNIITSAMKEKIYNNLLANYEKIATRLSRVN<br>SAPPEYDINEYKDYFQWKYGLDKNADGSYTVNENKFNEIYKKLYSFTEI<br>DLANKlKVKCRNTYFIKhGFrKVPNLLDDDIYTVSEGFNIGhLAVNNRGQ<br>NIKLNlKIIDSIPDKGLVkKIVKF | 162 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNkHTPINEFHPVTRTTSVNIKSSTNVKSSIIL<br>NLLVLGAGPnIFEtytYPVRKLMDSGGVYDPSkDGFGSINImTFSPEYEYTF<br>NDISGGYNSSTESFIADPAISLAHELIHALHGLYGAlGVTYKETIKVKQsP | 163 |

TABLE 28-continued

| Sequence | SEQ ID NO |
|---|---|
| LMIAEKPIRLEEFLTFGGQDLNIITSAMKEKIYNNLLANYEKIATRLSRVN SAPPEYDINEYKDYFQWKYGLDKNADGSYTVNENKFNEIYKKLYSFTEI DLANKlKVKCRNTYFIKhGFrKVPNLLDDDIYTVSEGFNIGhLAVNNRGQ NIKLNlKIIDSIPDKGLVkKIVKF | |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEaLLQEISYAKPYLGNEHTPINEFHPVTRTTSVNIKSSTNVKSSIIL NLLVLGAGPnIFENySYPVRKLMDSGGVYDPSkDGFGSINIVTFSPEYkYT FNDISGGYNSSTESFIADPAISLAHELIHALHGLYGAlGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYSFT EIDLANKlKVKCRNTYFIKhGFLKVPNLLDDDIYTVSEGFNIGhLAVNNR GQNIKLNlKIIDSIPDKawlrKs*KF | 164 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEaLLQEISYAKPYLGNEHTPINEFHPVTRTTSVNIKSSTNVKSSIIL NLLVLGAGPnIFENySYPVRKLMDSGGVYDPSkDGFGSINIVTFSPEYkYT FNDISGGYNSSTESFIADPAISLAHELIHALHGLYGAlGVTYKETIKVKQA PLMIAEKPIRLEEFLTFGGQDLNIITSAMKEKIYNNLLANYEKIATRLSRV NSAPPEYDINEYKDYFQWKYGLDKNADGSYsVNENKFNEIYKKLYSFT EIDLANKlKVKCRNTYFIKhGFLKVPNLLDDDIYTVSEGFNIGhLAVNNR GQNIKLNlKIIDSIPDKGLVkKIVKF | 165 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEaLLQEISYAKPYLGNEHTPINEFHPVTRTTSVNIKSSTNVKSSIIL NLLVLGAGPnIFENySYPVRKLMDSGGVYDPSkDGFGSINIVTFSPEYkYT FNDISGGYNSSTESFIADPAISLAHELIHALHGLYGAlGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYSFT EIDLANKlKVKCRNTYFIKhGFLKVPNLLDDDIYTVSEGFNIGhLAVNNR GQNIKLNlKIIDSIPDKGLVkKIVKF | 166 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEaLLQEISYAKPYLGNEHTPINEFHPVTRTTSVNIKSSTNVKSSIIL NLLVLGAGPnIFENySYPVRKLMDSGGVYDPSkDGFGSINIVTFSPEYkYT FNDISGGcNSSTESFIADPAISLAHELIHALHGLYGAlGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYSFT EIDLANKlKVKCRNTYFIKhGFLKVPNLLDDDIYTVSEGFNIGhLAVNNR GQNIKLNlKIIDSIPDKGLVkKIVKF | 167 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEaLLQEISYAKPYLGNEHTPINEFHPVTRTTSVNIKSSTNVKSSIIL NLLVLGAGPnIFENySYPVRKLMDSGGVYDPSkDGFGSINIVTFSPEYkYT FNDISGGYNSSTESFIADPAISLAHELIHALHGLYGAlGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKnLYSFT EIDLANKlKVKCRNTYFIKhGFLKVPNLLDDDIYTVSEGFNIGhLAVNNR GQNIKLNlKIIDSIPDKawlrKs*KF | 168 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSkDGFGSINIVTFSPEYEY TFNDISGGYNSSTESFIADPAISLAHELIHALHGLYGAlGVTYKETIKVKQ APLMIAEKPIRLEEFLTFGGQDLNIIcSAMKEKIYNNLLANYEKIATRLSR VNSAPPEYDINEYKDYFQWKYGLDKNADGSYTVNENKFNEIYKKLYSF TEIDLANKlKVKCRNTYFIKhGFLKVPNLLDDDIYTVSEGFNIGhLAVNN RGQNIKLNlKIIDSIPDKGLVkKIVKF | 169 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEaLLQEISYAKPYLGNEHTPINEFHPVTRTTSVNIKSSTNVKSSIIL NLLVLGAGPnIFENySYPVRKLMDSGGVYDPSkDGFGSINIVTFSPEYkYT FNDISGGYNSSTESFIADPAISLAHELIHALHGLYGAlGVTYKETIKVKQA PLMIAEKPIRLEEFLTFGGQDLNIITSAMKEKIYNNLLANYEKIAmRLSRV NSAPPEYDINEYKDYFQWKYGLDKNADGSYTVNENKFNEIYKKLYSFT EIDLANKlKVKCRNTYFIKhGFLKVPNLLDDDIYTVSEGFNIGhLAVNNR GQNIKLNlKIIDSIPDKGLVkKIVKF | 170 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL | 171 |

TABLE 28-continued

| Sequence | SEQ ID NO |
|---|---|
| NLLVLGAGPDIFENySYPVRKLMDSGGVYDPSNDGFGSINIVTFSPEYEY<br>TFNDISGGYNSSsESFIADPAISLAHELIHALHGLYGARGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKFKVKCRNTYFIKYGFLKVPNLLDDDIYTVSEGFNIGNLAVN<br>NRGQNIKLNPKIIDpIPDKGLVEKIVKF | |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLsGARGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKFKVKCRNTYFIKYGFLKVPdLLDDDIYTVSEGFNIGNLAVNN<br>RGQNIKLNPKIIDSIPDKGLVEKIVKF | 172 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIAmRL<br>SRVNSAPPEYDINEYKDYFQWKYGLDKNADGSYTVNENKFNEIYKKLY<br>SFTEIDLANKFKVKCRNTYFIKYGFLKVPNLLDDDIYTVSEGFNIGNLAV<br>NNRGQNIKLNPKIIDSvPDKGLVEKIVKF | 173 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | 174 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEd<br>TFNDISGGYdSSTESFIADPAISLAHELIHALHGLYGARGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNeDGSYTVNENKFNEIYKKLYSF<br>TEIDLANKFKVKCRNTYFIKhGFLKVPdLLDDDIYTVSEGFNIGNLAVNN<br>RGQNIKLNPKIIDSIPDKGLVEKIVKF | 175 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSsESFIADPAISLAHELIHALHGLYGARGVTYKETIKVKQ<br>APLMIAEKPIRLEEFLTFGGQDLNIITSAMKEKIYNNLLANYEKIATRLSR<br>\ASAPPEYDINEYKDYFQWKYGLDKNADGSYTVNENKFNEIYKKLYSFT<br>EIDLANKFKVKCRNTYFIKYGFLKVPNLLDDDIYTVSEGFNIGNLAVNN<br>RGQNIKLNPKIIDSIPDKGLVEKIVKF | 176 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDnGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKdADGSYTVNENKFNEIYKKLYS<br>FTEIDLANKFKVKCRNTYFIKYGFLKVPdLLDDDIYTVSEGFNIGNLAVN<br>NRGQNIKLNPKIIDSIPDKGLVEKIVKF | 177 |
| MPVVINSFNYNDPVNDDTILYMQIPYEEKSKKYYKAFEIMhNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK | 178 |

TABLE 28-continued

| Sequence | SEQ ID NO |
|---|---|
| QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPdLLDDDIYTVSEGFNIGNLAVN<br>NRGQNIKLNPKIIDSIPDKGLVEKIVKF | |
| MPVVINSFNYNDPVNDDTILYMQIPYEEKSKKYYKAFEIMhNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNADGSYTVNkNKFNEIYKKLYS<br>FTEIDLANKFKVKCRNTYFIKYGFLKVPdLLDDDIYTVSEGFNIGNLAVN<br>NRGQNIKLNPKIIDSIPDKGLVEKIVKF | 179 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPdLLDDDIYTVSEGFNIGNLAVN<br>NRGQNIKLNPKIIDSIPDKGLVEKIVKF | 180 |
| MPVVINSFNYNDPVNDDTILYMQIPYEEKSKKYYKAFEIMRNVWIIPER<br>NTIGTnPSDFDPPASLENGSSAYYDPNYLTTDAEKDRYLKTTIKLFnRINS<br>NPAGEVLLQEISsAKPYLGNEHTPINEFHPVTRTTSVNIKSSTNVKSSIILN<br>LLVLGAGPDIFENySYPVRKLMDSGGVYDPSNDGFGSINIVTFSPEYEYT<br>FNDISGGYNSSTESFIADPAISLAHELIHALHGLYGARGVTYKETIKVKQ<br>APLMIAEKPIRLEElLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKFKVKCRNTYFIKYGFLKVPNLLDDDIYTVSEGFNIGNLAVN<br>NRGQNIKLNPKIIgSIPDKGLVEKIVKF | 181 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPShDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKnYNNLLANYEKIATRL<br>SRVNSAPPEYDINEYKDYFQWKYGLDKNADGSYTVNENKFNEIYKKLY<br>SFTEIDLANKFKVKCRNTYFIKYGFLKVPdLLDDDIYTVSEGFNIGNLAV<br>NNRGQNIKLNPKIIDSIPDKGLVEKIVKF | 182 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEElLTFGGQDLNIITSAMKEKIYNNLLANYEKIAThLSh<br>VNSAPPEYDINEYKDYFQWKYGLDKNADGSYTVNENKFNEIYKKLYSF<br>TEIDLANKFKVKCRNTYFIKYGlLKVPdLLDDDIYTVSEGFNIGNLAVNN<br>RGQNIKLNPKIIDSIPDKGLVEKIVKF | 183 |
| MPVVINSFNYNDPVNDDTILYMQIPYEEKSKKYYKAFEIMhNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGNLAVNN<br>RGQNIKLNPKIIgSIPDKGLVEKIVKF | 184 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKFKVKCRNTYFIKhGFLKVPNLLDDDIYTVSEGFNIGNLAVNN<br>RGQNIKLNPKIIDSIPDKGLVEKIVKF | 185 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISYAKPYLGNEHTPINEFHPVTRTTSVNIKSSTNVKSSIIL | 186 |

TABLE 28-continued

| Sequence | SEQ ID NO |
|---|---|
| NLLVLGAGPDIFENySYPVRKLMDSGGVYDPSNDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFLKVPNLLDDDIYTVSEGFNIGNLAVNN RGQNIKLNPKIIDSIPDKGLVEKIVKF | |
| MPVVINSFNYNDPVNDDTILYMQIPYEEKSKKYYKAFEIMhNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSNDGFGSINIVTFSPEYEY TFNDISGGYNSSTESFIADPAISLAHELIHALHGLYGAlGVTYKETIKVKQ APLMIAgKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFLKVPNLLDDDIYTVSEGFNIGNLAVNN RGQNIKLNPKIIgSIPDKGLVEKIVKF | 187 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSNDGFGSINIVTFSPEYEY TFNDISGGYNSSTESFIADPAISLAHELIHALHGLYGAlGVTYKETIKVKQ APLMIAgKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFLKVPNLLDDDIYTVSEGFNIGNLAVNN RGQNIKLNPKIIDSIPDKGLVEKIVKF | 188 |
| MPVVINSFNYNDPVNDDTILYMQIPYEEKSKKYYKAFEIMhNVWIIPER NTIGTDPSDFDPPASLENGSSAYYDPNYLTTDAEKDRYLKTTIKLFKRIN SNPAGEVLLhEISYAKPYLGNEHTPINEFHPVTRTTSVNIKSSTNVKSSIIL NLLVLGAGPDIFENySYPVRKLMDSGGVYDPSNDGFGSINIVTFSPEYEY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKaKCRNTYFIKhGFLKVPNLLDDDIYTVSEGFNIGNLAVNN RGQNIKLNPKIIgSIPDKGLVEKIVKF | 189 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRINi NPAGEVLLQEISYAKPYLGNEHTPINEFHPVTRTTSVNIKSSTNVKSSIIL NLLVLGAGPDIFENySYPVRKLMDSGGVYDPSNDGFGSINIVTFSPEYEY TFNDISGGYNSSTESFIADPAISLAHELIHALHGLYGARGVTYKETIKVK QAPLMIAEKPIRLEEFLTFGGQDLNIITSAMKEKIYNNLLANYEKIATRLS RVNSAPPEYDINEYKDYFQWKYGLDKNADGSYTVNENKFNEIYKKLYS FTEIDLANKFKVKCRNTYFIKYGFLKVPNLLDDDIYTVSEGFNIGNLAVN NRGQNIKLNPKIIDSIPDKGLVEKIVKF | 190 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNdHTPINEFHPVTRTTSVNIKSSTNVKSSIIL NLLVLGAGPDIFENySYPVRKLMDSGGVYDPSNDGFGSINIVTFSPEYEY TFNDISGGYNSSTESFIADPAISLAHELIHALHGLYGARGVTYKETIKVK QAPLMIAEKPIRLEElLTFGGQDLNIITSAMKEKIYNNLLANYEKIATRLS RVNSAPPEYDINEYKDYFQWKYGLDKNADGSYTVNENKFNEIYKKLYS FTEIgLANKFKVKCRNTYFIKYGFLKVPNLLDDDIYTVSEGFNIGNLAVN NRGQNIKLNPKIIDSIPDKGLVEKIVKF | 191 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSNDGFGSINIVTFSPEYEY TFNDISGGYNSSTESFIADPAISLAHELIHALHGLYGARGVTYKETIKVK QAPLMIAEKPIRLEEFLTFGGQDLNIITSAMKEKIYNNLLANYEKIATRLS RVNSAPPEYDINEYKDYFQWKYGLDKNADGSYTVNENKFNEIYKKLYS FTEIDLANKFKVKCRNTYFIKYGFLKVPNLLDDDIYTVSEGFNIGNLAVN NRGQNIKLNPKIIDSIPDKGLVEKIVKF | 192 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPvGEVLLQEISYAKPYLGNEHTPINEFHPVTRTTSVNIKSSTNVKSSIIL NLLVLGAGPDIFENySYPVRKLMDSGGVYDPSNDGFGSINIVTFSPEYEY TFNDISGGYNSSTESFIADPAISLAHELIHALHGLYGARGVTYKETIKVK | 193 |

TABLE 28-continued

| Sequence | SEQ ID NO |
|---|---|
| QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNeDGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | 194 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKs | 195 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADrAISLAHELIHALHGLYGARGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKFKVKCRNTYFIKYGFLKVPNLLDDDIYTVSEGFNIGNLAVN<br>NRGQNIKLNPKIIDSIPDKGLVEKIVKF | 196 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSsPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | 197 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLsNYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | 198 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRINi<br>NPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | 199 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNdHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEElLTFGGQDLNIITSAMKEKIYNNLLANYEKIATRLS<br>RVNSAPPEYDINEYKDYFQWKYGLDKNADGSYTVNENKFNEIYKKLYS<br>FTEIgLANKFKVKCRNTYFIKYGFLKVPNLLDDDIYTVSEGFNIGNLAVN<br>NRGQNIKLNPKIIDSIPDKGLVEKIVKF | 200 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL | 201 |

TABLE 28-continued

| Sequence | SEQ ID NO |
|---|---|
| NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPvGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | 202 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNeDGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | 203 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKs | 204 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADrAISLAHELIHALHGLYGARGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKFKVKCRNTYFIKYGFLKVPNLLDDDIYTVSEGFNIGNLAVN<br>NRGQNIKLNPKIIDSIPDKGLVEKIVKF | 205 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSsPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | 206 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLsNYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | 207 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENSSYPVRKLMDSGGVYDPSNDGFGSINIVTFSPEYEY<br>TFNDISGGYNSSTESFIADPAISLAHELIHALHGLYGARGVTYKETIKVK | 208 |

TABLE 28-continued

| Sequence | SEQ ID NO |
|---|---|
| QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | 209 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>StPAGEVLLQEISYAKPYLGNEHTPINEFHPVTRTTSVNIKSSTNVKSSIIL<br>NLLVLGAGPDIFENySYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | 210 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRINT<br>SNPAGEVLLQEISYAKPYLGNEHTPINEFHPVTRTTSVNIKSSTNVKSSIIL<br>NLLVLGAGPDIFENSSYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | 211 |
| MPVVINSFNYNDPVNDDTILYMQIPYEEKSKKYYKAFEIMRNVWIIPER<br>NTIGTDPSDFDPPtSLdNGSSAYYDPNYLTTDAEKDRYLKTTIKLFKRINS<br>NPAGEVLLQEISYAKPYLGNEHTPINEFHPVTRTTSVNIKSSTNVKSSIIL<br>NLLVLGAGPDIFENySYPVRKLMgSGGVYDPSkDGFGSINIVTFSPEYgYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGNLAVNNR<br>GQNIKLNlKIIDSIPDKawlrKs*KF | 212 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRINT<br>SNPAGEaLLQEISdAKPYLGNEHTPINEFHPVTRTTSVNIKSSTNVKSSIIL<br>NLLVLGAGPDIFENySYPVRKLMDSGGVYDPSNDGFGSINIVTFSPEYkY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGNLAVNN<br>RGQNIKLNlKIIDSIPDKvLVEKIVKF | 213 |
| MPVVINSFNYNDPVNDDTILYMQIPYEEKSKKYYKAFEIMRNVWIIPER<br>NTIGTDPSDFDPPASLkNGSSAYYDPNYLTTDAEKDRYLKTTIKLFKRIN<br>SNPAGEaLLQEISdAKPYLGNEHTPINEFHPVTRTTSVNIKSSTNVKSSIIL<br>NLLVLGAGPDIFENySYPVRKLMDSGGVYDPShDGFGSINIVTFSPEYkY<br>TFNDISGGYNSSTESFIADPAISLAHELIHALHGLYGAlGVaYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGhLAVNN<br>RGQNIKLNlKIIDSIPDKvLiEKIVKF | 214 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRINT<br>SNPAGEaLLQEISsAKPYLGNEHTPINEFHPVTRTTSVNIKSSTNVKSSIIL<br>NLLVLGAGPDIFENySYPVRKLMDgGGVYDPSNDGFGSINIVTFSPEYkY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGNLAVNN<br>RGQNIKLNlKIIDSIPDKGwlrKs*KF | 215 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRINT<br>SNPAGEaLLQEISsAKPYLGNEHTPINEFHPVTRTTSVNIKSSTNVKSSIIL | 216 |

TABLE 28-continued

| Sequence | SEQ ID NO |
|---|---|
| NLLVLGAGPDIFENySYPVRKLMDSGGVYDPShDGFGSINIVTFSPEYkY TFNDISGdYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFLKVPNLLDDDIYTVSEGFNIGNLAVNN RGQNIKLNlKIIDSIPDKGwlrKs*KF | |
| MPVVINSFNYsDPVNDDTILYMQIPYEEKSKKYYKAFEIMRNVWIIPERN TIGTDPSDFDPPASLENGSSAYYDPNYLTTDAEKDRYLKTTIKLFKRINS NPAGEaLLQEISdAKPYLGNEHTPINEFHPVTRTTSVNIKSSTNVKSSIILN LLVLGAGPDIFENySYPVRKLMDSGGVYDPSNDGFGSINIVTFSPEYkYT FNDISGGYNSSaESFIADPAISLAHELIHALHGLYGAlGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYSFT EIDLANKlKVKCRNTYFIKhGFLKVPNLLDDDIYTVSEGFNIGNLAVNNR GQNIKLNlKIIDSIPDKvLVEKIVKF | 217 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRINT SNPAGEaLLQEISdAKPYLGNEHTPINEFyPVTRTTSVNIKSSTNVKSSIILN LLVLGAGPDIFENySYPVRKLMDSGGVYDPSNDGFGSINIVTFSPEYkYT FNDISGGYNSSTESFIADPAISLAHELIHALHGLYGAlGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYSFT EIDLANKlKVKCRNTYFIKhGFLKVPNLLDDDIYTVSEGFNIGNLAVNNR GQNIKLNlKIIDSIPDKvLVEKIVKF | 218 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRINT SNPAGEVLLQEISdAKPYLGNEHTPINEFHPVTRTTSVNIKSSTNVKSSIIL NLLVLGAGPDIFENySYPVRKLMDSGGVYDPShDGFGSINIVTFSPEYkY TFNDISGGYNSSTESFIADPAISLAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFLKVPNLLDDDIYTVSEGFNIGNLAVNN RGQNIKLNlKIIDSIPDKawlrKs*KF | 219 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRINT SNPAGEaLLQEISYAKPYLGNEHTPINEFHPVTRTTSVNIKSSTNVKSSIIL NLLVLGAGPDIFENySYPVRKLMDSGGVYDPSsDGFGSINIVTFSPEYkYT FNDISGGYNSSTESFIADPAISLAHELIHALHGLYGAlGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYgFT EIDLANKlKVKCRNTYFIKhGFLKVPNLLDDDIYTVSEGFNIGNLAVNNR GQNIKLNlKIIDSIPDKawlrKs*KF | 220 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRINT SNPAGEaLLQEISYAKPYLGNEHTPINEFHPVTRTTSVNIKSSTNVKSSIIL NLLVLGAGPDIFENySYPVRKLMDSGGVYDPSsDGFGSINIVTFSPEYkYT FNDISGGYNSSTESFIADPAISLAHELIHALHGLYGAlGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYgFT EIDLANKlKVKCRNTYFIKhGFLKVPNLLDDDIYTVSEGFNIGhLAVNNR GQNIKLNlKIIDSIPDKawlrKs*KF | 221 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRINT SNPAGEVLLQEISdAKPYLGNEHTPINEFHPVTRTTSVNIKSSTNVKSSIIL NLLVLGAGPDIFENycYPVRKLMDSGGVYDPShDGFGSINIVTFSPEYkYT FNDISGGYNSSTESFIADPAISLAHELIHALHGLYGAlGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYgFT EIDLANKlKVKCRNTYFIKhGFLKVPNLLDDDIYTVSEGFNIGhLAVNNR GQNIKLNlKIIDSIPDKawlrKs*KF | 222 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISdAKPYLGNEHTPINEFHPVTRTTSVNIKSSTNVKSSIIL NLLVLGAGPDIFENySYPVRKLMDSGGVYDPShDGFGSINIVTFSPEYkY TFNDISGGYNSSTESFIADPAISLAHELIHALHGLYGAlGVTYKETIKVKQ | 223 |

TABLE 28-continued

| Sequence | SEQ ID NO |
|---|---|
| APLMIAEKPIRLEEFLTFGGQDLNlITSAMKEKIYNNLLANYEKIATRLSR<br>VNSAPPEYDINEYKDYFQWKYGLDKNADGSYTVNENKFNEIYKKLYgF<br>TEIDLANKlKVKCRNTYFIKhGFLKVPNLLDDDIYTVSEGFNIGNLAVNN<br>RGQNIKLNlKIIDSIPDKawlrKs*KF | |
| MPVVINSFNYNDPVNDDTILYMQIPYEEKSKKYYKAFEIMRNVWIIPER<br>NTIGTDPSDFDPPASLENGSSAYYDPdYLTTDAEKDRYLKTTIKLFKRINTS<br>NPAGEaLLQEISdAKPYLGNEHTPINEFHPVTRTTSVNIKSSTNVKSSIILN<br>LLVLGAGPDIFENySYPVRKLMDSGGVYDPShDGFGSINIVTFSPEYkYTF<br>NDISGGYNSSTESFIADPAISLAHELIHALHGLYGAlGVTYKETIKVKQAP<br>LMIAEKPIRLEEFLTFGGQDLNIITSAMKEKIYNNLLANYEKIATRLSRVN<br>SAPPEYDINEYKDYFQWKYGLDKNADGSYTVNENKFNEIYKKLYgFTEI<br>DLANKlKVKCRNTYFIKhGFLKVPNLLDDDIYTVSEGFNIGNLAVNNRG<br>QNIKLNlKIIDSIPDKawlrKs*KF | 224 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYkY<br>TFNDISGGYNSSTESFIADPAISLAHELIHALHGLYGAlGVTcKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYiF<br>TEIDLANKlKVKCRNTYFIKhGFLKVPNLLDDDIYTVSEGFNIGhLAVNN<br>RGQNIKLNlKIIDSIPDKGLVkKIVKF | 225 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYkY<br>TFNDISGGYNSSTESFIADPAISLAHELIHALHGLYGAlGVTcKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGhLAVNN<br>RGQNIKLNlKIIDSIPDKGLVkKIVKF | 226 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYkY<br>TFNDISGGYNSSTESFIADPAISLAHELIHALHGLYGAlGVTcKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGhLAVNN<br>RGQNIKLNlKIIDSIPDKGLVkKIVKF | 227 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENSSYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | 228 |
| MPVVINSFNYNDPVNDDTILYMQIPYEEKSKKYYKAFEIMRNVWIIPER<br>NTIGTDPSDFDPPASLdNGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMgSGGVYDPSkDGFGSINIVTFSPEYgYT<br>FNDISGGYNSSTESFIADPAIiLAHELIHALHGLYGAfGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGNLAVNNR<br>GQNIKLNlKIIDSIPDKawlrKs*KF | 229 |
| MPVVINSFNYNDPVNDDTILYMQIPYEEKSKKYYKAFEIMRNVWIIPER<br>NTIGTDPSDFDPPASLdNGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMgSGGVYDPSkDGFGSINIVTFSPEYgYT<br>FNDISGGYNSSTESFIADPAIiLAHELIHALHGLYGAfGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPdLLDDDIYTVSEGFNIGNLAVNNR<br>GQNIKLNlKIIDSIPDKawlrKs*KF | 230 |
| MPVVINSFNYNDPVNDDTILYMQIPYEEKSKKYYKAFEIMRNVWIIPER<br>NTIGTDPSDFDPPASLdNGSSAYYDPNYLTTDAEKDRYLKTTIKLFKRIN<br>SNPAGEVLLQEISYAKPYLGNEHTPINEFHPVTRTTSVNIKSSTNVKSSIIL | 231 |

TABLE 28-continued

| Sequence | SEQ ID NO |
|---|---|
| NLLVLGAGPDIFENySYPVRKLMgSGGVYDPSkDGFGSINIVTFSPEYgYT<br>FNDISGGYNSSgESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIehGFLKVPNLLDDDIYTVSEGFNIGNLAVNNR<br>GQNIKLNlKIIDSIPDKawlrKs*KF | |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISYAKPYLGNEHTPINEFHPVTRTTSVNIKSSTNVKSSIIL<br>NLLVLGAGPDIFENyiYPVRKLMDSGGVYDPSNDGFGSINIVTFSPEYgYT<br>FNDISGGYhSSTESFIADPAIiLAHELIHALHGLYGAlGVTYKETIKVKQAP<br>LMIAEKPIRLEEFLTFGGQDLNIITSAMKEKIYNNLLANYEKIATRLSRVN<br>SAPPEYDINEYKDYFQWKYGLDKNADGSYTVNENKFNEIYKKLYgFTEI<br>DLANKlKVKCRNTYFIKhGFLKVPNLLDDDIYTVSEGFNIGhLAVNNRGQ<br>NIKLNlKIIDSIPDKawlrKs*KF | 232 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISYAKPYLGNEHTPINEFHPVTRTTSVNIKSSTNVKSSIIL<br>NLLVLGAGPDIFENyiYPVRKLMDSGGVYDPSNDGFGSINIVTFSPEYgYT<br>FNDISGGYNSSTESFIADPAIiLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYgFT<br>EIDLANKlKVKCRNTYFIKhGFLKVPNLLDDDIYTVSEGFNIGhLAVNNR<br>GQNIKLNlKIIDSIPDKawlrKs*KF | 233 |
| MPVVINSFNYNDPVNDDTILYMQIPYEEKSKKYYKAFEIMRNVWIIPER<br>NTIGTDPSDFDPPASLENGSSAYYDPdYLTTDAEKDRYLKTTIKLFKRINTS<br>NPAGEaLLQEISYAKPYLGNEHTPINEFHPVTRTTSVNIKSSTNVKSSIILN<br>LLVLGAGPDIFENyiYPVRKLMDSGGVYDPSNDGFGSINIVTFSPEYgYTF<br>NDISGGYNSSTESFIADPAIiLAHELIHALHGLYGAlGVTYKETIKVKQAP<br>LMIAEKPIRLEEFLTFGGQDLNIITSAMKEKIYNNLLANYEKIATRLSRVN<br>SAPPEYDINEYKDYFQWKYGLDKNADGSYTVNENKFNEIYKKLYgFTEI<br>DLANKlKVKCRNTYFIKhGFLKVPNLLDDDIYTVSEGFNIGhLAVNNRGQ<br>NIKLNlKIIDSIPDKawlrKs*KF | 234 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYgY<br>TFNDISGGYNSSTESFIADPAELAHELIHALHGLYGAfGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGhLAVNN<br>RGQNIKLNlKIIDSIPDKGLVkKIVKF | 235 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYgY<br>TFNDISGGYNSSTESFIADPAISLAHELIHALHGLYGAfGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYsVNENKFNEIYKKLYSF<br>TEIDLANKlKVKCRNTYFIKhGFLKVPNLLDDDIYTVSEGFNIGhLAVNN<br>RGQNIKLNlKIIDSIPyKGLVkKIVKF | 236 |
| MPVVINSFNYNDPVNDDTILYMQIPYEEKSKKYYKAFEIMRNVWIIPER<br>NTIGTDPSDFDPPASLENGsfAYYDPNYLTTDAEKDRYLKTTIKLFKRINTS<br>NPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYgY<br>TFNDISGGYNSSTESFIADPAISLAHELIHALHGLYGAfGVTiKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFrKVPNLLDDDIYTVSEGFNIGhLAVNNR<br>GQNIKLNlKIIDSIPDKGLVkKIVKF | 237 |
| MPVVINSFNYNDPVNDDTILYMQIPYEEKSKKYYKAFEIMRNVWIIPER<br>NTIGTDPSDFDPPdSLENGSSAYYDPNYLTTDAEKDRYLKTTIKLFKRINS<br>NPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYgY<br>TFNDISGGYNSSTESFIADPAISLAHELIHALHGLYGAlsVTiKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGhLAVNNR<br>GQNIKLNlKIIDSIPDKGLVkKIVKF | 238 |

TABLE 28-continued

| Sequence | SEQ ID NO |
| --- | --- |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSkDGFGSINIVTFSPEYgY TFNDISGGYNSSTESFIADPAISLAHELIHALHGLYGAfGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFLKVPNLLDDDIYTVSEGFNIGhLAVNN RGQNIKLNlKIIDSIPDKGLVkKIVKF | 239 |
| MPVVINSFNYNDPVNDDTILYMQIPYEEKSKKYYKAFEIMRNVWIIPER NTIGTDPSDFDPPASLENGSfAYYDPNYLTTDAEKDRYLKTTIKLFKRINS NPAGEVLLQEISYAKPYLGNEHTPINEFHPVTRTTSVNIKSSTNVKSSIIL NLLVLGAGPDIFENySYPVRKLMDSGGVYDPSkDGFGSINIVTFSPEYgY TFNDISGGYNSSTESFIADPAISLAHELIHALHGLYGAlGVTiKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYSFT EIDLANKlKVKCRNTYFIKhGFrKVPNLLDDDIYTVSEGFNIGhLAVNNRG QNIKLNlKIIDSIPDKGLVkKIVKF | 240 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENSSYPVRKLMDSGGVYDPSNDGFGSINIVTFSPEYEY TFNDISGGYNSSTESFIADPAISLAHELIHALHGLYGARGVTYKETIKVK QAPLMIAEKPIRLEEFLTFGGQDLNIITSAMKEKIYNNLLANYEKIATRLS RVNSAPPEYDINEYKDYFQWKYGLDKNADGSYTVNENKFNEIYKKLYS FTEIDLANKFKVKCRNTYFIKYGFLKVPNLLDDDIYTVSEGFNIGNLAVN NRGQNIKLNPKIIDSIPDKGLVEKIVKF | 241 |
| MPVVINSFNYNDPVNDDTILYMQIPYEEKSKKYYKAFEIMRNVWIIPER NTIGTDPSDFDPPASLdNGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMSGGVYDPSkDGFGSINIVTFSPEYgYT FNDISGGYNSSTESFIADPAIiLAHELIHALHGLYGAfGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYSFT EIDLANKlKVKCRNTYFIKhGFLKVPNLLDDDIYTVSEGFNIGNLAVNNR GQNIKLNlKIIDSIPDKawlrKs*KF | 242 |
| MPVVINSFNYNDPVNDDTILYMQIPYEEKSKKYYKAFEIMRNVWIIPER NTIGTDPSDFDPPASLdNGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMgSGGVYDPSkDGFGSINIVTFSPEYgYT FNDISGGYNSSTESFIADPAIiLAHELIHALHGLYGAfGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYSFT EIDLANKlKVKCRNTYFIKhGFLKVPdLLDDDIYTVSEGFNIGNLAVNNR GQNIKLNlKIIDSIPDKawlrKs*KF | 243 |
| MPVVINSFNYNDPVNDDTILYMQIPYEEKSKKYYKAFEIMRNVWIIPER NTIGTDPSDFDPPASLdNGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMgSGGVYDPSkDGFGSINIVTFSPEYgYT FNDISGGYNSSgESFIADPAISLAHELIHALHGLYGAlGVTYKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYSFT EIDLANKlKVKCRNTYFIehGFLKVPNLLDDDIYTVSEGFNIGNLAVNNR GQNIKLNlKIIDSIPDKawlrKs*KF | 244 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEaLLQEISYAKPYLGNEHTPINEFHPVTRTTSVNIKSSTNVKSSIIL NLLVLGAGPDIFENyiYPVRKLMDSGGVYDPSNDGFGSINIVTFSPEYgYT FNDISGGYhSSTESFIADPAIiLAHELIHALHGLYGAlGVTYKETIKVKQAP LMIAEKPIRLEEFLTFGGQDLNIITSAMKEKIYNNLLANYEKIATRLSRVN SAPPEYDINEYKDYFQWKYGLDKNADGSYTVNENKFNEIYKKLYgFTEI DLANKlKVKCRNTYFIKhGFLKVPNLLDDDIYTVSEGFNIGhLAVNNRGQ NIKLNlKIIDSIPDKawlrKs*KF | 245 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEaLLQEISYAKPYLGNEHTPINEFHPVTRTTSVNIKSSTNVKSSIIL NLLVLGAGPDIFENyiYPVRKLMDSGGVYDPSNDGFGSINIVTFSPEYgYT FNDISGGYNSSTESFIADPAIiLAHELIHALHGLYGAlGVTYKETIKVKQA | 246 |

TABLE 28-continued

| Sequence | SEQ ID NO |
|---|---|
| PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYgFT<br>EIDLANKlKVKCRNTYFIKhGFLKVPNLLDDDIYTVSEGFNIGhLAVNNR<br>GQNIKLNlKIIDSIPDKawlrKs*KF | |
| MPVVINSFNYNDPVNDDTILYMQIPYEEKSKKYYKAFEIMRNVWIIPER<br>NTIGTDPSDFDPPASLENGSSAYYDPdYLTTDAEKDRYLKTTIKLFKRINTS<br>NPAGEaLLQEISYAKPYLGNEHTPINEFHPVTRTTSVNIKSSTNVKSSIILN<br>LLVLGAGPDIFENyiYPVRKLMDSGGVYDPSNDGFGSINIVTFSPEYgYTF<br>NDISGGYNSSTESFIADPAIiLAHELIHALHGLYGAlGVTYKETIKVKQAP<br>LMIAEKPIRLEEFLTFGGQDLNISAMKEKIYNNLLANYEKIATRLSRVN<br>SAPPEYDINEYKDYFQWKYGLDKNADGSYTVNENKFNEIYKKLYgFTEI<br>DLANKlKVKCRNTYFIKhGFLKVPNLLDDDIYTVSEGFNIGhLAVNNRGQ<br>NIKLNlKIIDSIPDKawlrKs*KF | 247 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYgY<br>TFNDISGGYNSSTESFIADPAELAHELIHALHGLYGAfGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGhLAVNN<br>RGQNIKLNlKIIDSIPDKGLVkKIVKF | 248 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYgY<br>TFNDISGGYNSSTESFIADPAISLAHELIHALHGLYGAfGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYsVNENKFNEIYKKLYSF<br>TEIDLANKlKVKCRNTYFIKhGFLKVPNLLDDDIYTVSEGFNIGhLAVNN<br>RGQNIKLNlKIIDSIPyKGLVkKIVKF | 249 |
| MPVVINSFNYNDPVNDDTILYMQIPYEEKSKKYYKAFEIMRNVWIIPER<br>NTIGTDPSDFDPPASLENGSfAYYDPNYLTTDAEKDRYLKTTIKLFKRINTS<br>NPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYgY<br>TFNDISGGYNSSTESFIADPAISLAHELIHALHGLYGAfGVTiKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFrKVPNLLDDDIYTVSEGFNIGhLAVNNR<br>GQNIKLNlKIIDSIPDKGLVkKIVKF | 250 |
| MPVVINSFNYNDPVNDDTILYMQIPYEEKSKKYYKAFEIMRNVWIIPER<br>NTIGTDPSDFDPPdSLENGSSAYYDPNYLTTDAEKDRYLKTTIKLFKRINS<br>NPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYgY<br>TFNDISGGYNSSTESFIADPAISLAHELIHALHGLYGAlsVTiKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGhLAVNNR<br>GQNIKLNlKIIDSIPDKGLVkKIVKF | 251 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYgY<br>TFNDISGGYNSSTESFIADPAISLAHELIHALHGLYGAfGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGhLAVNN<br>RGQNIKLNlKIIDSIPDKGLVkKIVKF | 252 |
| MPVVINSFNYNDPVNDDTILYMQIPYEEKSKKYYKAFEIMRNVWIIPER<br>NTIGTDPSDFDPPASLENGSfAYYDPNYLTTDAEKDRYLKTTIKLFKRINS<br>NPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYgY<br>TFNDISGGYNSSTESFIADPAISLAHELIHALHGLYGAlGVTiKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFrKVPNLLDDDIYTVSEGFNIGhLAVNNRG<br>QNIKLNlKIIDSIPDKGLVkKIVKF | 253 |
| MPVVINSFNYNDPVNDDTILYMQIPYEEKSKKYYKAFEIMRNVWIIPER<br>NTIGTDPSDFDPPASLdNGSSAYYDPNYLTTDAEKDRYLKTTIKLFKRIN<br>SNPAGEVLLQEISYAKPYLGNEHTPINEFHPVTRTTSVNIKSSTNVKSSIIL | 254 |

TABLE 28-continued

| Sequence | SEQ ID NO |
|---|---|
| NLLVLGAGPDIFENySYPVRKLMgSGGVYDPSkDGFGSINIVTFSPEYgYT<br>FNDISGGYNSSTESFIADPAISLAHELIHALHGLYGAfGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGNLAVNNR<br>GQNIKLNlKIIDSIPDKawlrKs*KF | |
| MPVVINSFNYNDPVNDDTILYMQIPYEEKSKKYYKAFEIMRNVWIIPER<br>NTIGTDPSDFDPPASLdNGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMgSGGVYDPSkDGFGSINIVTFSPEYgYT<br>FNDISGGYNSSTESFIADPAIiLAHELIHALHGLYGAfGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGNLAVNNR<br>GQNIKLNlKIIDSIPDKawlrKs*KF | 255 |
| MPVVINSFNYNDPVNDDTILYMQIPYEEKSKKYYKAFEIMRNVWIIPER<br>NTIGTDPSDFDPPASLdNGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMgSGGVYDPSkDGFGSINIVTFSPEYgYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIehGFLKVPNLLDDDIYTVSEGFNIGNLAVNNR<br>GQNIKLNlKIIDSIPDKawlrKs*KF | 256 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISdAKPYLGNEHTPINEFHPVTRTTSVNIKSSTNVKSSIIL<br>NLLVLGAGPDIFENycYPVRKLMDSGGVYDPShDGFGSINIVTFSPEYgYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYgFT<br>EIDLANKlKVKCRNTYFIKhGFLKVPNLLDDDIYTVSEGFNIGNLAVNNR<br>GQNIKLNlKIIDSIPDKawlrKs*KF | 257 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISdAKPYLGNEHTPINEFHPVTRTTSVNIKSSTNVKSSIIL<br>NLLVLGAGPDIFENyiYPVRKLMDSGGVYDPShDGFGSINIVTFSPEYgYT<br>FNDISGGhNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYgFT<br>EIDLANKlKVKCRNTYFIKhGFLKVPNLLDDDIYTVSEGFNIGNLAVNNR<br>GQNIKLNlKIIDSIPDKawlrKs*KF | 258 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SiPAGEVLLQEISYAKPYLGNEHTPINEFHPVTRTTSVNIKSSTNVKSSIIL<br>NLLVLGAGPDIFENycYPVRKLMDSGGVYDPShDGFGSINIVTFSPEYgYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYgFT<br>EIDLANKlKVKCRNTYFIKhGFLKVPNLLDDDIYTVSEGFNIGNLAVNNR<br>GQNIKLNlKIIDSIPDKawlrKs*KF | 259 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISdAKPYLGNEHTPINEFHPVTRTTSVNIKSSTNVKSSIIL<br>NLLVLGAGPDIFENySYPVRKLMDSGGVYDPSsDGFGSINIVTFSPEYgYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYgFT<br>EIDLANKlKVKCRNTYFIKhGFLKVPdLLDDDIYTVSEGFNIGhLAVNNRG<br>QNIKLNlKIIDSIPDKawlrKs*KF | 260 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEaLLQEISYAKPYLGNEHTPINEFHPVTRTTSVNIKSSTNVKSSIIL<br>NLLVLGAGPDIFENyiYPVRKLMDSGGVYDPShDGFGSINIVTFSPEYaYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV | 261 |

TABLE 28-continued

| Sequence | SEQ ID NO |
|---|---|
| NSAPPEYDINEYKDYFQWKYGLDKNADGSYTVNENKFNEIYKKLYgFT EIDLANKlKVKCRNTYFIKhGFLKVPNLLDDDIYTVSEGFNIGhLAVNNR GQNIKLNlKIIDSIPDKawlrKs*KF | |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSkDGFGSINIVTFSPEYgY TFNDISGGYNSSTESFIADPAELAHELIHALHGLYGAfGVTYKETIKVKQ APLMIAEKPIRLEEFLTFGGQDLNIITSAMKEKIYNNLLANYEKIATRLSR VNSAPPEYDINEYKDYFQWKYGLDKNADGSYsVNENKFNEIYKKLYSF TEIDLANKlKVKCRNTYFIKhGFLKVPNLLDDDIYTVSEGFNIGhLAVNN RGQNIKLNlKIIDSIPyKGLVkKIVKF | 262 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSkDGFGSINIVTFSPEYgY TFNDInGGYNSSTESFIADPAELAHELIHALHGLYGAfGVTYKETIKVKQ APLMIAEKPIRLEEFLTFGGQDLNIITSAMKEKIYNNLLANYEKIATRLSR VNSAPPEYDINEYKDYFQWKYGLDKNADGSYTVNENKFNEIYKKLYSF TEIDLANKlKVKCRNTYFIKhGFrKVPNLLDDDIYTVSEGFNIGhLAVNNR GQNIKLNlKIIDSIPyKGLVkKIVKF | 263 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSkDGFGSINIVTFSPEYgY TFNDISGGYNSSTESFIADPAELAHELIHALHGLYGAfGVTYKETIKVKQ APLMIAEKPIRLEEFLTFGGQDLNIITSAMKEKIYNNLLANYEKIATRLSR VNSAPPEYDINEYKDYFQWKYGLDKNADGSYsVNENKFNEIYKKLYSF TEIDLANKlKVKCRNTYFIKhGFLKVPNLLDDDIYTVSEGFNIGhLAVNN RGQNIKLNlKIIDSIPDKGLVkKIVKF | 264 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSkDGFGSINIVTFSPEYgY TFNDISGGYNSSTESFIADPAELAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYsVNENKFNEIYKKLYSF TEIDLANKlKVKCRNTYFIKhGFLKVPNLLDDDIYTVSEGFNIGhLAVNN RGQNIKLNlKIIDSIPyKGLVkKIVKF | 265 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEaLLQEISYAKPYLGNEHTPINEFHPVTRTTSVNIKSSTNVKSSIIL NLLVLGAGPDIFENySYPVRKLMDSGGVYDPSkDGFGSINIVTFSPEYgY TFNDISGGYNSSTkSFIADPAIiLAHELIHALHGLYGAlGVTcKETIKVKQA PLMIAEKPIRLEEFLTFGGQDLNIITSAMKEKIYNNLLANYEKIATRLSRV NSAPPEYDINEYKDYFQWKYGLDKNADGSYTVNENKFNEIYKKLYSFT EIDLANKlKVKCRNTYFIehGFLKVPNLLDDDIYTVSEGFNIGhLAVNNRG QNIKLNlKIIDSIPDKGLVkKIVKF | 266 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSkDGFGSvNIVTFSPEYgY TFNDISGGYNSSTESFIADPAELAHELIHALHGLYGAlGVTYKETIKVKQ APLMIAEKPIRLEEFLTFGGQDLNIITSAMKEKIYNNLLANYEKIATRLSR VNSAPPEYDINEYKDYFQWKYGLDKNADGSYsVNENKFNEIYKKLYSF TEIDLANKlKVKCRNTYFIKhGFLKVPNLLDDDIYTVSEGFNIGhLAVNN RGQNIKLNlKIIDSIPyKGLVkKIVKF | 267 |
| MPVVINSFNYNDPVNDDTILYMQIPYEEKSKKYYKAFEIMRNVWIIPER NTIGTDPSDFDPPASLENGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMDSGGVYDPSkDGFGSINIVTFSPEYgY TFNDISGGYNSSTESFIADPAELAHELIHALHGLYGAfGVTYKETIKVKQ APLMIAEKPIRLEEFLTFGGQDLNIITSAMKEKIYNNLLANYEKIATRLSR VNSAPPgYDINEYKDYFQWKYGLDKNADGSYsVNENKFNEIYKKLYSF TEIDLANKlKVKCRNTYFIKhGFLKVPNLLDDDIYTVSEGFNIGhLAVNN RGQNIKLNlKIIDSIPyKGLVkKIVKF | 268 |
| MPVVINSFNYNDPVNDDTILYMQIPYEEKSKKYYKAFEIMRNVWIIPER NTIGTDPSDFDPPASLdNGSSAYYDPNYLTTDAEKDRYLKTTIKLFKRIN SNPAGEVLLQEISYAKPYLGNEHTPINEFHPVTRTTSVNIKSSTNVKSSIIL NLLVLGAGPDIFENySYPVRKLMgSGGVYDPSkDGFGSINIVTFSPEYgT | 269 |

| Sequence | SEQ ID NO |
|---|---|
| FNDISGGYNSSTESFIADPAISLAHELIHALHGLYGAfGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGNLAVNNR<br>GQNIKLNlKIIDSIPDKawlrKs*KF | |
| MPVVINSFNYNDPVNDDTILYMQIPYEEKSKKYYKAFEIMRNVWIIPER<br>NTIGTDPSDFDPPtSLdNGSSAYYDPNYLTTDAEKDRYLKTTIKLFKRINS<br>NPAGEVLLQEISYAKPYLGNEHTPINEFHPVTRTTSVNvKSSTNVKSSIIL<br>NLLVLGAGPDIFENySYPVRKLMgSGGVYDPSkDGFGSINIVTFSPEYgYT<br>FNDISGGYNSSTESFIADPAISLAHELIHALHGLYGAfGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGNLAVNNR<br>GQNIKLNlKIIDSIPDKawlrKs*KF | 270 |
| MPVVINSFNYNDPVNDDTILYMQIPYEEKSKKYYKAFEIMRNVWIIPER<br>NTIGTDPSDFDPPASLdNGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMgSGGVYDPSkDGFGSINIVTFSPEYgYT<br>FNDISGGYNSSTgSFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIehGFLKVPNLLDDDIYTVSEGFNIGNLAVNNR<br>GQNIKLNlKIIDSIPDKawlrKs*KF | 271 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRINT<br>SNPAGEaLLQEISYAKPYLGNEHTPINEFHPVTRTTSVNIKSSTNVKSSIIL<br>NLLVLGAGPDIFENySYPVRKLMDSGGVYDPSsDGFGSINIVTFSPEYkYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYgFT<br>EIDLANKlKVKCRNTYFIKhGFLKVPNLLDDDIYTVSEGFNIGNLAVNNR<br>GQNIKLNlKIIDSIPDKawlrKs*KF | 272 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRINT<br>SNPAGEVLLQEISdAKPYLGNEHTPINEFHPVTRTTSVNIKSSTNVKSSIIL<br>NLLVLGAGPDIFENycYPVRKLMDSGGVYDPShDGFGSINIVTFSPEYkYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYgFT<br>EIDLANKlKVKCRNTYFIKhGFLKVPNLLDDDIYTVSEGFNIGNLAVNNR<br>GQNIKLNlKIIDSIPDKawlrKs*KF | 273 |
| MPVVINSFNYNDPVNDDTILYMQIPYEEKSKKYYKAFEIMRNVWIIPER<br>NTIGTDPSDFDPPASLENGSSAYYDPdYLTTDAEKDRYLKTTIKLFKRINTS<br>NPAGEVLLQEISdAKPYLGNEHTPINEFHPVTRTTSVNIKSSTNVKSSIILN<br>LLVLGAGPDIFENycYPVRKLMDSGGVYDPShDGFGSINIVTFSPEYkYTF<br>NDISGGYNSSTESFIADPAISLAHELIHALHGLYGAlGVTYKETIKVKQAP<br>LMIAEKPIRLEEFLTFGGQDLNIITSAMKEKIYNNLLANYEKIATRLSRVN<br>SAPPEYDINEYKDYFQWKYGLDKNADGSYTVNENKFNEIYKKLYgFTEI<br>DLANKlKVKCRNTYFIKhGFLKVPNLLDDDIYTVSEGFNIGNLAVNNRG<br>QNIKLNlKIIDSIPDKawlrKs*KF | 274 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRINT<br>SNPAGEaLLQEISdAKPYLGNEHTPINEFHPVTRTTSVNIKSSTNVKSSIIL<br>NLLVLGAGPDIFENycYPVRKLMDSGGVYDPShDGFGSINIVTFSPEYkYT<br>FNDISGGYNSSTESFIADPAISLAHELIHALHGLYGAlGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYgFT<br>EIDLANKlKVKCRNTYFIKhGFLKVPNLLDDDIYTVSEGFNIGNLAVNNR<br>GQNIKLNlKIIDSIPDKawlrKs*KF | 275 |
| MPVVINSFNYNDPVNDDTILYMQIPYEEKSKKYYKAFEIMRNVWIIPER<br>NTIGTDPSDFyPPASLENGSSAYYDPNYLTTDAEKDRYLKTTIKLFKRINS<br>NPAGEaLLQEISYAKPYLGNEHTPINEFHPVTRTTSVNIKSSTNVKSSIIL<br>LLVLGAGPDIFENySYPVRKLMDSGGVYDPSsDGFGSINIVTFSPEYkYTF<br>NDISGGYNSSTESFIADPAISLAHELIHALHGLYGAlGVTYKETIKVKQAP<br>LMIAEKPIRLEEFLTFGGQDLNIITSAMKEKIYNNLLANYEKIATRLSRVN<br>SAPPEYDINEYKDYFQWKYGLDKNADGSYTVNENKFNEIYKKLYgFTEI<br>DLANKlKVKCRNTYFIKhGFLKVPdLLDDDIYTVSEGFNIGhLAVNNRGQ<br>NIKLNlKIIDSIPDKawlrKs*KF | 276 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRINT | 277 |

TABLE 28-continued

| Sequence | SEQ ID NO |
|---|---|
| SNPAGEVLLQEISdAKPYLGNEHTPINEFHPVTRTTSVNIKSSTNVKSSIIL<br>NLLVLGAGPDIFENySYPVRKLMDSGGVYDPShDGFGSINIVTFSPEYkY<br>TFNDISGGYNSSTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYgF<br>TEIDLANKlKVKCRNTYFIKhGFLKVPNLLDDDIYTVSEGFNIGNLAVNN<br>RGQNIKLNlKIIDSIPDKawlrKs*KF | |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRINT<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYkY<br>TFNDISGGYNSSTESFIADPAISLAHELIHALHGLYGAlGVTcKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFrKVPdLLDDDIYTVSEGFNIGhLAVNNR<br>GQNIKLNlKIIDSIPDKcLVkKIVKF | 278 |
| MPVVINSFNYNDPVNDDTILYMQIPYEEKSKKYYKAFEItRNVWIIPERN<br>TIGTDPSDFDPPASLENGSSAYYDPNYLTTDAEKDRYLKTTIKLFKRINS<br>NPAGaVLLQEISYAKPYLGNEHTPINEFHPVTRTTSVNIKSSTNVKSSIILN<br>LLVLGAGPDIFENySYPVRKLMDSGGVYDPSkDGFGSINIVTFSPEYkYTF<br>NDISGGYNSSTESFIADPAISLAHELIHALHGLYGAlGVTcKETIKVKQAP<br>LMIAEKPIRLEEFLTFGGQDLNIITSAMKEKIYNNLLANcEKIATRLSRVN<br>SAPPEYDINEYKDYFQWKYGLDKNADGSYTVNENKFNEIYKKLYSFTEI<br>DLANKlKVKCRNTYFIehGFLKVPNLLDDDIYTVSEGFNIGhLAVNNRGQ<br>NIKLNlKIIDSIPDKGLVkKIVKF | 279 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRINT<br>SNPAGaVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEhkYT<br>FNDISGGYNSSTESFIADPAISLAHELIHALHGLYGAlGVTcKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGhLAVNNR<br>GQNIKLNlKIIDSIPDKGLVkKIVKF | 280 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYgY<br>TFNDISGGYNSyTESFIADPAISLAHELIHALHGLYGAlGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDvYTVSEGFNIGhLAVNN<br>RGQNIKLNlKIIDSIPDKGLVkKIVKF | 281 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFyPVTRTTSVNIKSSTNVKSSIIL<br>NLLVLGAGPDIFENySYPVRKLMDSGGVYDPSkDGFGSINIVTFSPEYkY<br>TFNDISGGYNSSTESFIADPAISLAHELIHALHGLYGAlGVTcKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYSF<br>TEIDLANKlKVKCRNTYFIKhGFLKVPNLLDDDIYTVSEGFNIGhLAVNN<br>RGQNIKLNlKIIDSIPDKGLVkKIVKF | 282 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENySYPVRKLMDSGGVYDPSkDGFGSINIVTFSPEYkY<br>TFNDISGGYNSSTESFIADPAISLAHELIHALHGLYGAfGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYsVNENKFNEIYKKLYSF<br>TEIDLANKlKVKCRNTYFIKhGFLKVPNLLDDDIYTVSEGFNIGhLAVNN<br>RGQNIKLNlKIIDSIPDKGLVkKIVKF | 283 |
| MPVVINSFNYNDPVNDDTILYMQIPYEEKSKKYYKAFEIMRNVWIIPER<br>NTIGTDPSDFDPPASLENGSfAYYDPNYLTTDAEKDRYLKTTIKLFKRINS<br>NPAGEVLLQEISYAKPYLGNEHTPINEFHPVTRTTSVNIKSSTNVKSSIIL<br>NLLVLGAGPDIFkNySYPVRKLMDSGGVYDPSkDGFGSINIVTFSPEYgYT<br>FNDISGGYNSSTESFIADPAISLAHELIHALHGLYGAfGVTYKETIKVKQA<br>PLMIAEKPIRLEEFLTFGGQDLNIITSAMKEKIYNNLLANYEKIATRLSRV<br>NSAPPEYDINEYKDYFQWKYGLDKNADGSYTVNENKFNEIYKKLYSFT<br>EIDLANKlKVKCRNTYFIKhGFLKVPNLLDDDIYTVSEGFNIGhLAVNNR<br>GQNIKLNlKIIDSIPDKGLVkKIVKF | 284 |

TABLE 28-continued

| Sequence | SEQ ID NO |
|---|---|
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEVLLQEISYAKPYLGNEHTPINEFHPVTRTTSVNIKSSTNVKSSIIL<br>NLLVLGAGPDIFENSSYPVRKLMDSGGVYDPSNDGFGSINIVTFSPEYEY<br>TFNDISGGYNSSTESFIADPAISLAHELIHALHGLYGARGVTYKETIKVK<br>QAPLMIAEKPIRLEEFLTFGGQDLNIITSAMKEKIYNNLLANYEKIATRLS<br>RVNSAPPEYDINEYKDYFQWKYGLDKNADGSYTVNENKFNEIYKKLYS<br>FTEIDLANKFKVKCRNTYFIKYGFLKVPNLLDDDIYTVSEGFNIGNLAVN<br>NRGQNIKLNPKIIDSIPDKGLVEKIVKF | 285 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEALLQEISYAKPYLGNEHTPINEFHPVTRTTSVNIKSSTNVKSSIIL<br>NLLVLGAGPDIFENYIYPVRKLMDSGGVYDPSNDGFGSINIVTFSPEYGY<br>TFNDISGGYNSSTESFIADPAIILAHELIHALHGLYGALGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYGF<br>TEIDLANKLKVKCRNTYFIKHGFLKVPNLLDDDIYTVSEGFNIGHLAVN<br>NRGQNIKLNLKIIDSIPDKAWLRKS | 390 |
| MPVVINSFNYNDPVNDDTILYMQIPYEEKSKKYYKAFEIMRNVWIIPER<br>NTIGTDPSDFDPPASLENGSSAYYDPNYLTTDAEKDRYLKTTIKLFKRIN<br>SNPAGEALLQEISYAKPYLGNEHTPINEFHPVTRTTSVNIKSSTNVKSSIIL<br>NLLVLGAGPDIFENYIYPVRKLMDSGGVYDPSNDGFGSINIVTFSPEYGY<br>TFNDISGGYNSSTESFIADPAIILAHELIHALHGLYGALGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYGF<br>TEIDLANKLKVKCRNTYFIKHGFLKVPNLLDDDIYTVSEGFNIGHLAVN<br>NRGQNIKLNLKIIDSIPDKAWLRKS | 391 |
| MPVVINSFNYNDPVNDDTILYMQIPYEEESKKYYKAFEIMRNVWIIPER<br>NTIGTDPSDFDPPASLENGSSAYYDPNYLTTDAEKDRYLKTTIKLFKRIN<br>SNPAGEALLQEISYAKPYLGNEHTPINEFHPVTRTTSVNIKSSTNVKSSIT<br>LNLLVLGAGPDIFENYIYPVRKLTDSGGVYDPSNDGFGSINIVTFSPEYG<br>YTFNDISGGYNSSTESFIADPAIILAHELIHALHGLYGALGVTYKETIKVK<br>QAPLMIAEKPIRLEEFLTFGGQDLNIITSAMKEKIYNNLLANYEKIATRLS<br>CVNSAPPEYDINEYKDYFQWKYGLDKNADGSYTVNENKFNEIYKKLY<br>GFTEIDLANKLKVKCRNTYFIKHGFLKVPNLLDDDIYTVSEGFNIGHLA<br>VNNRGQNIKLNLKIIDSIPDKAWLRKS | 392 |
| MPVVINSFNYNDPVNDDTILYMQIPYEEKSKKYYKAFEIMRNVWIIPER<br>NTIGTDPSDFDPPASLENGSSAHYDPNYLTTDAEKDRYLKTTIKLFKRIN<br>SNPAGEALLQEISYAKPYLGNEHTPINEFHPGTRTTSVNIKTSTNVKSSIIL<br>NLLVLGAGPDIFENYIYPVRKLTDSGGVYDPSNDGFGSINIVTFSPEYGY<br>TFNDISGGYNSSTESFIADPAIILAHELIHALHGLYGALGVTYKETIKVKQ<br>APLMIAEKPIRLEEFLTFGGQDLNIITSAMKEKIYNNLLANYEKIATRLSR<br>VNSAPPEYDINEYKDYFQWKYGLDKNADGSYTVNENKFNEIYKKLYGF<br>TEIDLANKLKVKCRNTYFIKHGFLKVPNLLDDDIYTVSEGFNIGHLAVN<br>NRGQNIKLNLKIIDSIPDKAWLRKS | 393 |

This disclosure relates, in part, to the discovery that continuous evolution methods (e.g., PACE) are useful for producing BoNT protease variants that have altered peptide cleaving activities (altered peptide cleaving functions). For example, in some embodiments, a BoNT protease variant as described by the disclosure cleaves a VAMP7 or VAMP8 protein or peptide. In some embodiments, a BoNT protease variant as described by the disclosure cleaves a PTEN protein or peptide. In some embodiments, a BoNT protease variant as described by the disclosure cleaves the target sequence (SEQ ID NO: 314)
MAILFAVVARGTTILAKHAWCGGNFLEDFERSRAFNFLNEIKKRFQTTYG

SRAQTALPYAMNSEFSSVLAAQLKHHSENKGLDKVMETQAQVDELKGIMV

RNIDLVAQRGERLELLIDKTENLVDSSVTFKTTSRNLARAMCMKNLKLTI

IIIIVSIVFIYIIVSPLCGGFTWPSCVKK
or

-continued (SEQ ID NO: 315)
GGSGGSGGSKGLDKVMETQAQVDELKGIMVRNIDLVAQRGERLELLIDKT

ENLVDSSVTFKTTSRNLARGGSGGSGGS.

In some embodiments, a BoNT protease variant as described by the disclosure cleaves the target sequence (SEQ ID NO: 316)
MTAIIKEIVSRNKRRYQEDGFDLDLTYIYPNIIAMGFPAERLEGVYRNNI

DDVVRFLDSKHKNHYKIYNLCAERHYDTAKFNCRVAQYPFEDHNPPQLEL

IKPFCEDLDQWLSEDDNHVAAIHCKAGKGRTGVMICAYLLHRGKFLKAQE

ALDFYGEVRTRDKKGVTIPSQRRYVYYYSYLLKNHLDYRPVALLFHKMMF

ETIPMFSGGTCNPQFVVCQLKVKIYSSNSGPTRREDKFMYFEFPQPLPVC

```
GDIKVEFFHKQNKMLKKDKMFHFWVNTFFIPGPEETSEKVENGSLCDQEI

DSICSIERADNDKEYLVLTLTKNDLDKANKDKANRYFSPNFKVKLYFTKT

VEEPSNPEASSSTSVTPDVSDNEPDHYRYSDTTDSDPENEPFDEDQHTQI

TKV
or
                                          (SEQ ID NO: 317)
NGSLCDQEIDSICSIERADN.
```

In some embodiments, a BoNT protease variant as described herein cleaves a target sequence selected from:

```
(SNAP25)
                                          (SEQ ID NO: 318)
MAEDADMRNELEEMQRRADQLADESLESTRRMLQLVEESKDAGIRTLVML

DEQGEQLERIEEGMDQINKDMKEAEKNLTDLGKFCGLCVCPCNKLKSSDA

YKKAWGNNQDGVVASQPARVVDEREQMAISGGFIRRVTNDARENEMDENL

EQVSGIIGNLRHMALDMGNEIDTQNRQIDRIMEKADSNKTRIDEANQRAT

KMLGSG, (VAMP1)
                                          (SEQ ID NO: 319)
MSAPAQPPAEGTEGTAPGGGPPGPPPNMTSNRRLQQTQAQVEEVVDIIRV

NVDKVLERDQKLSELDDRADALQAGASQFESSAAKLKRKYWWKNCKMMIM

LGAICAIIVVVIVRRG, (SNAP25; SEQ ID NO: 320)
MGNEIDTQNRQIDRIMEKAD,
and
                                  (VAMP1; SEQ ID NO: 321)
TSNRRLQQTQAQVEEVVDIIRVNVDKVLERDQKLSELDDRADALQAGASQ

FESSAAKLKR,
``` and/or cleaves a VAMP7 peptide target sequence, for example,

```
                                          (SEQ ID NO: 322)
MAILFAVVARGTTILAKHAWCGGNFLEDFERSRAFNFLNEIKKRFQTTYG

SRAQTALPYAMNSEFSSVLAAQLKHHSENKGLDKVMETQAQVDELKGIMV

RNIDLVAQRGERLELLIDKTENLVDSSVTFKTTSRNLARAMCMKNLKLTI

IIIIVSIVFIYIIVSPLCGGFTWPSCVKK,
or
                                          (SEQ ID NO: 323)
GGSGGSGGSKGLDKVMETQAQVDELKGIMVRNIDLVAQRGERLELLIDKT

ENLVDSSVTFKTTSRNLARGGSGGSGGS.
```

In some embodiments, a BoNT protease variant cleaves a target peptide (e.g., VAMP7, VAMP8, PTEN, etc.) with higher activity than a wild-type BoNT protease. A BoNT protease variant that cleaves a target peptide (e.g., VAMP7, VAMP8, PTEN, etc.) with higher activity can have an increase in catalytic efficiency ranging from about 1.1-fold, about 1.5-fold, 2-fold to about 100-fold, about 5-fold to about 50-fold, or about 10-fold to about 40-fold, relative to the catalytic efficiency of the wild-type BoNT protease from which the BoNT protease variant was derived. In some embodiments, a BoNT protease variant described herein cleaves a target peptide (e.g., VAMP7, VAMP8, PTEN, etc.) with about 1% to about 100% (e.g., about 1%, 2%, 5%, 10%, 20%, 50%, 80%, 90%, 100%) of the catalytic efficiency with which wild-type BoNT cleaves its native substrate (e.g., SNAP25, VAMP1, etc.). Catalytic efficiency can be measured or determined using any suitable method known in the art, for example using the methods described in Harris et al. (2009) *Methods Enzymol.* 463; 57-71.

Generally, the evolution of proteases with altered specificity has focused exclusively on the destruction of therapeutically relevant extracellular proteins. However BoNTs provide a built-in cytosolic delivery mechanism, and thus are able, in some embodiments, to degrade intracellular targets. For example, in some embodiments, a BoNT protease variant as described herein comprises one or more protein domains that facilitate transport of the protease across a cellular membrane. In some embodiments, the one or more protein domains that facilitate transport across the membrane are selected from a BoNT HC, a BoNT HCC domain, and a BoNT HCN domain. In some embodiments, BoNT protease variants described by the disclosure are capable of crossing the cellular membrane and entering the intracellular environment of neuronal cell types.

Some aspects of this disclosure provide methods for using a protease provided herein. In some embodiments, such methods include contacting a protein comprising a protease target cleavage sequence, for example ex vivo, in vitro, or in vivo (e.g., in a subject), with the protease. In some embodiments, the protein contacted with the protease is a therapeutic target. In some embodiments, the therapeutic target is VAMP7. Generally, VAMP7 is an intracellular, soluble N-ethylmaleimide-sensitive factor attachment protein receptor (SNARE) family protein that mediates the fusion of transport vesicles to their target membrane. Without wishing to be bound by any particular theory, VAMP7 functions as a mediator of MT1-MMP secretion during tumor invasion and granzyme B and perform secretion, for example, during organ transplantation. Accordingly, in some aspects, the disclosure provides methods of decreasing VAMP7 activity in a cell, the method comprising contacting the cell with, or introducing into the intracellular environment of the cell, a variant BoNT protease as described herein.

In some embodiments, the therapeutic target is PTEN. Generally, PTEN is an intracellular protein comprising a tensin domain and a phosphatase domain that functions as a tumor suppressor. PTEN has also been observed to mediate ischemic neuronal damage after a stroke. Accordingly, in some aspects, the disclosure provides methods of decreasing PTEN activity in a cell, the method comprising contacting the cell with, or introducing into the intracellular environment, a BoNT protease variant as described herein (e.g., a BoNT E variant).

In some embodiments, the cell (or intracellular environment) is characterized by increased or undesired activity of a target protein (e.g., VAMP7, VAMP8, PTEN, etc.) relative to a normal cell or extracellular environment (e.g., a healthy cell, or extracellular environment, not characterized by increased activity of the target protein). In some embodiments, increased activity of a target protein (e.g., VAMP7, VAMP8, PTEN, etc.) occurs when, in a cell, the activity of the target protein is about 2-fold, 3-fold, 4-fold, 5-fold, 10-fold, 25-fold, 50-fold, 100-fold, 500-fold, or 1000-fold over activity of the target protein in a normal healthy cell, or extracellular environment. In some embodiments, a cell characterized by increased expression of a target protein (e.g., VAMP7, VAMP8, PTEN, etc.) is derived from a subject (e.g., a mammalian subject, such as a human or mouse) that has or is suspected of having a disease associated with increased activity of the target gene, for example, cancer in the context of VAMP7 overexpression or increased activity.

In some embodiments, the methods provided herein comprise contacting (e.g., cleaving) the target protein (e.g., VAMP7, PTEN, etc., or a protein comprising a peptide comprising an amino acid sequence set forth in SEQ ID NOs.: 314-323 (e.g., VAMP7, PTEN, etc.)) with a BoNT protease variant described herein in vitro. In some embodiments, the methods provided herein comprise contacting the target protein with the protease variant described herein in vivo. In some embodiments, the methods provided herein comprise contacting the target protein (e.g., VAMP7, PTEN, etc., or a protein comprising a peptide comprising an amino acid sequence set forth in SEQ ID NOs.: 314-323 (e.g., VAMP7, PTEN)) with a BoNT protease variant described herein in an intracellular environment. In some embodiments, the methods provided herein comprise contacting the target protein (e.g., VAMP7, PTEN, etc., or a protein comprising a peptide comprising an amino acid sequence set forth in SEQ ID NOs.: 314-323 (e.g. VAMP7, PTEN)) with a BoNT protease variant in a subject, e.g., by administering the protease to the subject, either locally or systemically. In some such embodiments, the protease variant is administered to the subject in an amount effective to result in a measurable decrease in the level of full-length (or functional) target protein (e.g., VAMP7, PTEN, etc.) in the subject, or in a measurable increase in the level of a cleavage product generated by the protease variant upon cleavage of the target protein.

Engineering of BoNT Protease Variants Using PACE

Some aspects of this disclosure provide methods for evolving a BoNT protease. In some embodiments, a method of evolving a protease is provided that comprises (a) contacting a population of host cells with a population of vectors comprising a gene encoding a protease to be evolved. The vectors are typically deficient in at least one gene required for the transfer of the phage vector from one cell to another, e.g., a gene required for the generation of infectious phage particles. In some embodiments of the provided methods, (1) the host cells are amenable to transfer of the vector; (2) the vector allows for expression of the protease in the host cell, can be replicated by the host cell, and the replicated vector can transfer into a second host cell; and (3) the host cell expresses a gene product encoded by the at least one gene for the generation of infectious phage particles (a) in response to the activity of the protease, and the level of gene product expression depends on the activity of the protease. The methods of protease evolution provided herein typically comprise (b) incubating the population of host cells under conditions allowing for mutation of the gene encoding the protease, and the transfer of the vector comprising the gene encoding the protease of interest from host cell to host cell. The host cells are removed from the host cell population at a certain rate, e.g., at a rate that results in an average time a host cell remains in the cell population that is shorter than the average time a host cell requires to divide, but long enough for the completion of a life cycle (uptake, replication, and transfer to another host cell) of the vector. The population of host cells is replenished with fresh host cells that do not harbor the vector. In some embodiments, the rate of replenishment with fresh cells substantially matches the rate of removal of cells from the cell population, resulting in a substantially constant cell number or cell density within the cell population. The methods of protease evolution provided herein typically also comprise (c) isolating a replicated vector from the host cell population of step (b), wherein the replicated vector comprises a mutated version of the gene encoding the protease.

Some embodiments provide a continuous evolution system, in which a population of viral vectors, e.g., M13 phage vectors, comprising a gene encoding a protease of interest to be evolved replicates in a flow of host cells, e.g., a flow through a lagoon, wherein the viral vectors are deficient in a gene encoding a protein that is essential for the generation of infectious viral particles, and wherein that gene is in the host cell under the control of a conditional promoter, the activity of which depends on the activity of the protease of interest. In some embodiments, transcription from the conditional promoter may be activated by cleavage of a fusion protein comprising a transcription factor and an inhibitory protein fused to the transcriptional activator via a linker comprising a target site of the protease.

Some embodiments of the protease PACE technology described herein utilize a "selection phage," a modified phage that comprises a gene of interest to be evolved and lacks a full-length gene encoding a protein required for the generation of infectious phage particles. In some such embodiments, the selection phage serves as the vector that replicates and evolves in the flow of host cells. For example, some M13 selection phages provided herein comprise a nucleic acid sequence encoding a protease to be evolved, e.g., under the control of an M13 promoter, and lack all or part of a phage gene encoding a protein required for the generation of infectious phage particles, e.g., gI, gII, gIII, gIV, gV, gVI, gVII, gVIII, gIX, or gX, or any combination thereof. For example, some M13 selection phages provided herein comprise a nucleic acid sequence encoding a protease to be evolved, e.g., under the control of an M13 promoter, and lack all or part of a gene encoding a protein required for the generation of infectious phage particles, e.g., the gIII gene encoding the pIII protein.

One prerequisite for evolving proteases with a desired activity is to provide a selection system that confers a selective advantage to mutated protease variants exhibiting such an activity. The expression systems and fusion proteins comprising transcriptional activators in an inactive form that are activated by protease activity thus constitute an important feature of some embodiments of the protease PACE technology provided herein.

In some embodiments, the transcriptional activator directly drives transcription from a target promoter. For example, in some such embodiments, the transcriptional activator may be an RNA polymerase. Suitable RNA polymerases and promoter sequences targeted by such RNA polymerases are well known to those of skill in the art. Exemplary suitable RNA polymerases include, but are not limited to, T7 polymerases (targeting T7 promoter sequences) and T3 RNA polymerases (targeting T3 promoter sequences). Additional suitable RNA polymerases will be apparent to those of skill in the art based on the instant disclosure, which is not limited in this respect.

In some embodiments, the transcriptional activator does not directly drive transcription, but recruits the transcription machinery of the host cell to a specific target promoter. Suitable transcriptional activators, such as, for example, Gal4 or fusions of the transactivation domain of the VP16 transactivator with DNA-binding domains, will be apparent to those of skill in the art based on the instant disclosure, and the disclosure is not limited in this respect.

In some embodiments, it is advantageous to link protease activity to enhanced phage packaging via a transcriptional activator that is not endogenously expressed in the host cells in order to minimize leakiness of the expression of the gene required for the generation of infectious phage particles through the host cell basal transcription machinery. For example, in some embodiments, it is desirable to drive expression of the gene required for the generation of infectious phage particles from a promoter that is not or is only minimally active in host cells in the absence of an exogenous transcriptional activator, and to provide the exogenous transcriptional activator, such as, for example, T7 RNA polymerase, as part of the expression system linking protease (e.g., BoNT protease variant) activity to phage packaging efficiency. In some embodiments, the at least one gene for the generation of infectious phage particles is expressed in the host cells under the control of a promoter activated by the transcriptional activator, for example, under the control of a T7 promoter if the transcriptional activator is T7 RNA polymerase, and under the control of a T3 promoter if the transcriptional activator is T3 polymerase, and so on.

In some embodiments, the transcriptional activator is fused to an inhibitor that either directly inhibits or otherwise hinders the transcriptional activity of the transcriptional activator, for example, by directly interfering with DNA binding or transcription, by targeting the transcriptional activator for degradation through the host cells protein degradation machinery, or by directing export from the host cell or localization of the transcriptional activator into a compartment of the host cell in which it cannot activate transcription from its target promoter. In some embodiments, the inhibitor is fused to the transcriptional activator's N-terminus. In other embodiments, it is fused to the activator's C-terminus.

In some embodiments, the protease evolution methods provided herein comprise an initial or intermittent phase of diversifying the population of vectors by mutagenesis, in which the cells are incubated under conditions suitable for mutagenesis of the gene encoding the protease in the absence of stringent selection or in the absence of any selection for evolved protease variants that have acquired a desired activity. Such low-stringency selection or no selection periods may be achieved by supporting expression of the gene for the generation of infectious phage particles in the absence of desired protease activity, for example, by providing an inducible expression construct comprising a gene encoding the respective packaging protein under the control of an inducible promoter and incubating under conditions that induce expression of the promoter, e.g., in the presence of the inducing agent. Suitable inducible promoters and inducible expression systems are described herein and in International PCT Application, PCT/US2011/066747, filed Dec. 22, 2011, published as WO 2012/088381 on Jun. 28, 2012; and U.S. Application, U.S. Ser. No. 13/922,812, filed Jun. 20, 2013; International PCT Application, PCT/US2015/057012, filed on Oct. 22, 2015, published as WO 2016/077052; and, PCT/US2016/027795, filed on Apr. 15, 2016, published as WO 2016/168631, the entire contents of each of which are incorporated herein by reference. Additional suitable promoters and inducible gene expression systems will be apparent to those of skill in the art based on the instant disclosure. In some embodiments, the method comprises a phase of stringent selection for a mutated protease version. If an inducible expression system is used to relieve selective pressure, the stringency of selection can be increased by removing the inducing agent from the population of cells in the lagoon, thus turning expression from the inducible promoter off, so that any expression of the gene required for the generation of infectious phage particles must come from the protease activity-dependent expression system.

One aspect of the PACE protease evolution methods provided herein is the mutation of the initially provided vectors encoding a protease of interest. In some embodiments, the host cells within the flow of cells in which the vector replicates are incubated under conditions that increase the natural mutation rate. This may be achieved by contacting the host cells with a mutagen, such as certain types of radiation or to a mutagenic compound, or by expressing genes known to increase the cellular mutation rate in the cells. Additional suitable mutagens will be known to those of skill in the art, and include, without limitation, those described in International PCT Application, PCT/US2011/066747, filed Dec. 22, 2011, published as WO 2012/088381 on Jun. 28, 2012; and U.S. Application, U.S. Ser. No. 13/922,812, filed Jun. 20, 2013; International PCT Application, PCT/US2015/057012, filed on Oct. 22, 2015, published as WO 2016/077052; and, PCT/US2016/027795, filed on Apr. 15, 2016, published as WO 2016/168631, the entire contents of each of which are incorporated herein by reference and the disclosure is not limited in this respect.

In some embodiments, the host cells comprise the accessory plasmid encoding the at least one gene for the generation of infectious phage particles, e.g., of the M13 phage, encoding the protease to be evolved and a helper phage, and together, the helper phage and the accessory plasmid comprise all genes required for the generation of infectious phage particles. Accordingly, in some such embodiments, variants of the vector that do not encode a protease variant that can untether the inhibitor from the transcriptional activator will not efficiently be packaged, since they cannot effect an increase in expression of the gene required for the generation of infectious phage particles from the accessory plasmid. On the other hand, variants of the vector that encode a protease variant that can efficiently cleave the inhibitor from the transcriptional activator will effect increased transcription of the at least one gene required for the generation of infectious phage particles from the accessory plasmid and thus be efficiently packaged into infectious phage particles.

In some embodiments, the protease PACE methods provided herein further comprises a negative selection for undesired protease activity in addition to the positive selection for a desired protease activity. Such negative selection methods are useful, for example, in order to maintain protease specificity when increasing the cleavage efficiency of a protease directed towards a specific target site. This can avoid, for example, the evolution of proteases that show a generally increased protease activity, including an increased protease activity towards off-target sites, which is generally undesired in the context of therapeutic proteases.

In some embodiments, negative selection is applied during a continuous evolution process as described herein, by penalizing the undesired activities of evolved proteases. This is useful, for example, if the desired evolved protease is an enzyme with high specificity for a target site, for example, a protease with altered, but not broadened, specificity. In some embodiments, negative selection of an undesired activity, e.g., off-target protease activity, is achieved by causing the undesired activity to interfere with pIII production, thus inhibiting the propagation of phage genomes encoding gene products with an undesired activity. In some embodiments, expression of a dominant-negative version of pIII or expression of an antisense RNA complementary to the gIII RBS and/or gIII start codon is linked to the presence of an undesired protease activity. Suitable negative selection strategies and reagents useful for negative selection, such as dominant-negative versions of M13 pIII, are described herein and in International PCT Application, PCT/US2011/066747, filed Dec. 22, 2011, published as WO 2012/088381 on Jun. 28, 2012; and U.S. Application, U.S. Ser. No. 13/922,812, filed Jun. 20, 2013; International PCT Application, PCT/US2015/057012, filed on Oct. 22, 2015, published as WO 2016/077052; and, PCT/US2016/027795, filed on Apr. 15, 2016, published as WO 2016/168631, the entire contents of each of which are incorporated herein by reference.

In some embodiments, counter-selection against activity on non-target substrates is achieved by linking undesired evolved protease activities to the inhibition of phage propagation. In some embodiments, a dual selection strategy is applied during a continuous evolution experiment, in which both positive selection and negative selection constructs are present in the host cells. In some such embodiments, the positive and negative selection constructs are situated on the same plasmid, also referred to as a dual selection accessory plasmid.

One advantage of using a simultaneous dual selection strategy is that the selection stringency can be fine-tuned based on the activity or expression level of the negative selection construct as compared to the positive selection construct. Another advantage of a dual selection strategy is that the selection is not dependent on the presence or the absence of a desired or an undesired activity, but on the ratio of desired and undesired activities, and, thus, the resulting ratio of pIII and pIII-neg that is incorporated into the respective phage particle.

For example, in some embodiments, the host cells comprise an expression construct encoding a dominant-negative form of the at least one gene for the generation of infectious phage particles, e.g., a dominant-negative form of the pIII protein (pIII-neg), under the control of an inducible promoter that is activated by a transcriptional activator other than the transcriptional activator driving the positive selection system. Expression of the dominant-negative form of the gene diminishes or completely negates any selective advantage an evolved phage may exhibit and thus dilutes or eradicates any variants exhibiting undesired activity from the lagoon.

For example, if the positive selection system comprises a T7 promoter driving the expression of the at least one gene for the generation of infectious phage particles, and a T7 RNA polymerase fused to a T7-RNA polymerase inhibitor via a linker comprising a protease target site that is cleaved by a desired protease activity, the negative selection system should be a non-T7 based system. For example, in some such embodiments, the negative selection system could be based on T3 polymerase activity, e.g., in that it comprises a T3 promoter driving the expression of a dominant-negative form of the at least one gene for the generation of infectious phage particles, and a T3 RNA polymerase fused to a T3-RNA polymerase inhibitor via a linker comprising a protease target site that is cleaved by an undesired protease activity. In some embodiments, the negative selection polymerase is a T7 RNA polymerase gene comprising one or more mutations that render the T7 polymerase able to transcribe from the T3 promoter but not the T7 promoter, for example: N67S, R96L, K98R, H176P, E207K, E222K, T375A, M4011, G675R, N748D, P759L, A798S, A819T, etc. In some embodiments the negative selection polymerase may be fused to a T7-RNA polymerase inhibitor via a linker comprising a protease target site that is cleaved by an undesired protease activity. When used together, such positive-negative PACE selection results in the evolution of proteases that exhibit the desired activity but not the undesired activity. In some embodiments, the undesired function is cleavage of an off-target protease cleavage site. In some embodiments, the undesired function is cleavage of the linker sequence of the fusion protein outside of the protease cleavage site.

Some aspects of this invention provide or utilize a dominant negative variant of pIII (pIII-neg). These aspects are based on the recognition that a pIII variant that comprises the two N-terminal domains of pIII and a truncated, termination-incompetent C-terminal domain is not only inactive but is a dominant-negative variant of pIII. A pIII variant comprising the two N-terminal domains of pIII and a truncated, termination-incompetent C-terminal domain was described in Bennett, N. J.; Rakonjac, J., Unlocking of the filamentous bacteriophage virion during infection is mediated by the C domain of pIII. *Journal of Molecular Biology* 2006, 356 (2), 266-73; the entire contents of which are incorporated herein by reference. The dominant negative property of such pIII variants has been described in more detail in PCT Application PCT/US2011/066747, published as WO 2012/088381 on Jun. 28, 2012, the entire contents of which are incorporated herein by reference.

The pIII-neg variant as provided in some embodiments herein is efficiently incorporated into phage particles, but it does not catalyze the unlocking of the particle for entry during infection, rendering the respective phage noninfectious even if wild type pIII is present in the same phage particle. Accordingly, such pIII-neg variants are useful for devising a negative selection strategy in the context of PACE, for example, by providing an expression construct comprising a nucleic acid sequence encoding a pIII-neg variant under the control of a promoter comprising a recognition motif, the recognition of which is undesired. In other embodiments, pIII-neg is used in a positive selection strategy, for example, by providing an expression construct in which a pIII-neg encoding sequence is controlled by a promoter comprising a nuclease target site or a repressor recognition site, the recognition of either one is desired.

In some embodiments, a protease PACE experiment according to methods provided herein is run for a time sufficient for at least 10, at least 20, at least 30, at least 40, at least 50, at least 100, at least 200, at least 300, at least 400, at least, 500, at least 600, at least 700, at least 800, at least 900, at least 1000, at least 1250, at least 1500, at least 1750, at least 2000, at least 2500, at least 3000, at least 4000, at least 5000, at least 7500, at least 10000, or more consecutive viral life cycles. In certain embodiments, the viral vector is an M13 phage, and the length of a single viral life cycle is about 10-20 minutes.

In some embodiments, the host cells are contacted with the vector and/or incubated in suspension culture. For example, in some embodiments, bacterial cells are incubated in suspension culture in liquid culture media. Suitable culture media for bacterial suspension culture will be apparent to those of skill in the art, and the invention is not limited in this regard. See, for example, *Molecular Cloning: A Laboratory Manual*, 2nd Ed., ed. by Sambrook, Fritsch, and Maniatis (Cold Spring Harbor Laboratory Press: 1989); Elizabeth Kutter and Alexander Sulakvelidze: *Bacteriophages: Biology and Applications*. CRC Press; 1$^{st}$ edition (December 2004), ISBN: 0849313368; Martha R. J. Clokie and Andrew M. Kropinski: *Bacteriophages: Methods and Protocols, Volume* 1: *Isolation, Characterization, and Interactions (Methods in Molecular Biology)* Humana Press; 1$^{st}$ edition (December, 2008), ISBN: 1588296822; Martha R. J. Clokie and Andrew M. Kropinski: *Bacteriophages: Methods and Protocols, Volume* 2: *Molecular and Applied Aspects*

(*Methods in Molecular Biology*) Humana Press; 1$^{st}$ edition (December 2008), ISBN: 1603275649; all of which are incorporated herein in their entirety by reference for disclosure of suitable culture media for bacterial host cell culture).

The protease PACE methods provided herein are typically carried out in a lagoon. Suitable lagoons and other laboratory equipment for carrying out protease PACE methods as provided herein have been described in detail elsewhere. See, for example, International PCT Application, PCT/US2011/066747, published as WO2012/088381 on Jun. 28, 2012, the entire contents of which are incorporated herein by reference. In some embodiments, the lagoon comprises a cell culture vessel comprising an actively replicating population of vectors, for example, phage vectors comprising a gene encoding the protease of interest, and a population of host cells, for example, bacterial host cells. In some embodiments, the lagoon comprises an inflow for the introduction of fresh host cells into the lagoon and an outflow for the removal of host cells from the lagoon. In some embodiments, the inflow is connected to a turbidostat comprising a culture of fresh host cells. In some embodiments, the outflow is connected to a waste vessel, or a sink. In some embodiments, the lagoon further comprises an inflow for the introduction of a mutagen into the lagoon. In some embodiments that inflow is connected to a vessel holding a solution of the mutagen. In some embodiments, the lagoon comprises an inflow for the introduction of an inducer of gene expression into the lagoon, for example, of an inducer activating an inducible promoter within the host cells that drives expression of a gene promoting mutagenesis (e.g., as part of a mutagenesis plasmid), as described in more detail elsewhere herein. In some embodiments, that inflow is connected to a vessel comprising a solution of the inducer, for example, a solution of arabinose.

In some embodiments, a PACE method as provided herein is performed in a suitable apparatus as described herein. For example, in some embodiments, the apparatus comprises a lagoon that is connected to a turbidostat comprising a host cell as described herein. In some embodiments, the host cell is an *E. coli* host cell. In some embodiments, the host cell comprises an accessory plasmid as described herein, a helper plasmid as described herein, a mutagenesis plasmid as described herein, and/or an expression construct encoding a fusion protein as described herein, or any combination thereof. In some embodiments, the lagoon further comprises a selection phage as described herein, for example, a selection phage encoding a protease of interest. In some embodiments, the lagoon is connected to a vessel comprising an inducer for a mutagenesis plasmid, for example, arabinose. In some embodiments, the host cells are *E. coli* cells comprising the F' plasmid, for example, cells of the genotype F'proA$^+$B$^+$Δ(lacIZY) zzf::Tn10(TetR)/endA1 recA1 galE15 galK16 nupG rpsL ΔlacIZYA araD139 Δ(ara,leu) 7697 mcrA Δ(mrr-hsdRMS-mcrBC) proBA::pir116 λ$^-$.

Some aspects of this invention relate to host cells for continuous evolution processes as described herein. In some embodiments, a host cell is provided that comprises at least one viral gene encoding a protein required for the generation of infectious viral particles under the control of a conditional promoter, and a fusion protein comprising a transcriptional activator targeting the conditional promoter and fused to an inhibitor via a linker comprising a protease cleavage site. For example, some embodiments provide host cells for phage-assisted continuous evolution processes, wherein the host cell comprises an accessory plasmid comprising a gene required for the generation of infectious phage particles, for example, M13 gIII, under the control of a conditional promoter, as described herein. In some embodiments, the host cells comprises an expression construct encoding a fusion protein as described herein, e.g., on the same accessory plasmid or on a separate vector. In some embodiments, the host cell further provides any phage functions that are not contained in the selection phage, e.g., in the form of a helper phage. In some embodiments, the host cell provided further comprises an expression construct comprising a gene encoding a mutagenesis-inducing protein, for example, a mutagenesis plasmid as provided herein.

In some embodiments, modified viral vectors are used in continuous evolution processes as provided herein. In some embodiments, such modified viral vectors lack a gene required for the generation of infectious viral particles. In some such embodiments, a suitable host cell is a cell comprising the gene required for the generation of infectious viral particles, for example, under the control of a constitutive or a conditional promoter (e.g., in the form of an accessory plasmid, as described herein). In some embodiments, the viral vector used lacks a plurality of viral genes. In some such embodiments, a suitable host cell is a cell that comprises a helper construct providing the viral genes required for the generation of infectious viral particles. A cell is not required to actually support the life cycle of a viral vector used in the methods provided herein. For example, a cell comprising a gene required for the generation of infectious viral particles under the control of a conditional promoter may not support the life cycle of a viral vector that does not comprise a gene of interest able to activate the promoter, but it is still a suitable host cell for such a viral vector.

In some embodiments, the host cell is a prokaryotic cell, for example, a bacterial cell. In some embodiments, the host cell is an *E. coli* cell. In some embodiments, the host cell is a eukaryotic cell, for example, a yeast cell, an insect cell, or a mammalian cell. The type of host cell, will, of course, depend on the viral vector employed, and suitable host cell/viral vector combinations will be readily apparent to those of skill in the art.

In some embodiments, the viral vector is a phage and the host cell is a bacterial cell. In some embodiments, the host cell is an *E. coli* cell. Suitable *E. coli* host strains will be apparent to those of skill in the art, and include, but are not limited to, New England Biolabs (NEB) Turbo, Top10F', DH12S, ER2738, ER2267, and XL1-Blue MRF'. These strain names are art recognized and the genotype of these strains has been well characterized. It should be understood that the above strains are exemplary only and that the invention is not limited in this respect.

In some PACE embodiments, for example, in embodiments employing an M13 selection phage, the host cells are *E. coli* cells expressing the Fertility factor, also commonly referred to as the F factor, sex factor, or F-plasmid. The F-factor is a bacterial DNA sequence that allows a bacterium to produce a sex pilus necessary for conjugation and is essential for the infection of *E. coli* cells with certain phage, for example, with M13 phage. For example, in some embodiments, the host cells for M13-PACE are of the genotype F'proA$^+$B$^+$Δ(lacIZY) zzf::Tn10(TetR)/endA1 recA1 galE15 galK16 nupG rpsL ΔlacIZYA araD139 Δ(ara,leu)7697 mcrA Δ(mrr-hsdRMS-mcrBC) proBA::pir116 λ.

Some of the embodiments, advantages, features, and uses of the technology disclosed herein will be more fully understood from the Examples below. The Examples are intended to illustrate some of the benefits of the present disclosure and to describe particular embodiments, but are not intended to exemplify the full scope of the disclosure and, accordingly, do not limit the scope of the disclosure.

EXAMPLES

Example 1

Among the most notable protein systems capable of cytoplasmic delivery are the Clostridial neurotoxins, which include seven serologically distinct Botulinum neurotoxins (BoNT A-G) and a single Tetanus Syntaxin neurotoxin (TeNT). These modular proteins are expressed as a single 150 kDa single protein, which is proteolyzed into two components, a 100 kDa "heavy chain" (HC) and 50 kDa "light chain" (LC), which remain associated through a single disulfide linkage. The BoNT HC is further subdivided into a HCC binding domain, responsible for binding to cholinergic motor nerve terminals, and HCN translocation domain. Upon binding and endocytosis by neurons, endosomal acidification drives a structural reorganization of the translocation domain (HCN) which transports the tethered LC zinc metalloprotease (BoNT LC) to the neurotoxins cytoplasm (FIG. 1). The protease is then released after reduction of the disulfide linkage, and proceeds to block neurotransmitter release by proteolytic cleavage of vesicular membrane fusion (SNARE) proteins, thereby causing paralysis (FIG. 1). The catalytic nature of this event, and the long intracellular lifetime of these proteases results in BoNT neurotoxins being among the most potent neurotoxic agents known.

Two BoNT serotypes (BoNT A and BoNT B) are approved for several therapeutic applications, including cervical dystonia, blepharospasm, and spasticity. Therapies based on wild-type BoNTs are notable for their exquisite selectivity for both neuronal cells and for specific SNARE proteins, but these characteristics also limit the broader application of these proteins for modulating cellular chemistry. While notable advances have been made in retargeting BoNT toxins to novel neuronal subtypes or to non-neuronal cells, the preferential SNARE substrates for BoNT LC proteases function primarily in neuronal signaling. Efforts to modify the activity of the BoNT LC protease to overcome this restriction have met with much more limited success, and the inaccessibility of new intracellular targets for BoNT LC proteases remains the primary barrier in extending BoNT-type therapeutic strategies.

Proteolysis represents one of the most common post-translational modifications, and the ability to redirect selective BoNT LC proteases to novel substrates within the cell would constitute a powerful therapeutic tool. Reprogramming proteases to permanently modify disease-associated proteins has been a longstanding goal within the protein engineering community, but the challenges of altering protease activity and selectivity have limited the broad utilization of proteases in medicine. Substantial efforts to reprogram proteases have demonstrated the feasibility of tuning protease activity and selectivity by directed evolution. However, because most reported successes to date have been limited to single-residue specificity changes, commonly with greatly impaired levels of activity, therapeutic applications of proteases have thus far been limited to proteases that perform native functions in vivo. BoNT proteases are not exempt from to this trend. Only limited success in protease engineering successes have been reported, and have thus far been unable to substantially broaden the applications of BoNT therapies.

Phage assisted continuous evolution (PACE) has recently emerged as a powerful strategy for the development of new activity in proteins, including new promoter selectivity in RNA polymerases, new binding selectivity among protein-DNA interactions, new binding activity in protein-protein interactions, and drug resistance among viral proteases. The PACE selection is built around a modified M13 filamentous bacteriophage, which is unable to infect new hosts due to a lack of the essential gene III and its product, the coat protein pIII (FIG. 2). This essential gene has been moved to *E. coli* host cells, and its transcription is placed under the control of a specified activity of interest. In order to select for improved activity, the protein to be evolved is carried by the phage (selection phage) and is expressed upon bacterial host infection. Because pIII is essential for this infection process, only phage carrying active library members will be able to produce infectious progeny, and their infectivity increases in proportion to the activity of the encoded protein. The selection itself takes place in a dynamic lagoon environment undergoing constant dilution with new *E. coli* cells and with constant outflow to removing inactive phage library members, thereby allowing only phage containing the most active protein variants to persist. The ability to perform and control in situ mutagenesis, selection, and replication in PACE offers many advantages over traditional directed evolution approaches. Generally, PACE enables much faster selections with large gene libraries, resulting in a ~100-fold increase in the rate of protein evolution efforts, as hundreds of rounds of evolution can be performed in the course of a one-week PACE experiment with minimal researcher intervention. Improvements in controlling selection stringency and mutagenesis rate allow PACE to cover a vast region of a given protein's adaptive landscape, making it a powerful approach that can surpass rational engineering efforts in accessing novel protein activities. While highly efficient, PACE selection requires linkage of protein activity to transcription of gene-III to drive the selection, for example, a protease-activated T7 RNA polymerase (referred to hereafter as T7-PAP) that is capable of driving the evolution of proteases including BoNT protease and the Hepatitis C viral (HCV) NS3/4Aprotease. In this example platform, gene-III is placed under the control of the T7 promoter, and the cognate T7 polymerase is expressed as a fusion construct with T7 lysozyme with a protease-sensitive linker. Because T7 lysozyme is a natural inhibitor of T7 RNAP, T7pos is unable to transcribe pIII until the linking domain is proteolytically cleaved. (FIG. 3). Upon hydrolysis, the T7 polymerase becomes activated, and is able to transcribe gene-III from the T7 promoter in the accessory plasmid. Importantly, the linker region in T7pos can be varied to accommodate a variety of cleavage sequence, and is sensitive to the intrinsic selectivity of a theco-expressed protease.

Eukaryotic organisms, including humans, rely heavily on lipid membranes to compartmentalize and control biochemical processes. Complementary sets of SNARE proteins control trafficking of vesicular organelles, and are the primary mechanism by which cells catalyze membrane fusion events that lead to secretion, autophagy, and membrane remodeling. Despite the obvious potential for controlling signal networks through control over these processes, this therapeutic strategy remains underexplored, and the only small-molecule secretion inhibitors known have limited clinical viability due to low specificity and high toxicity. BoNT neurotoxins, offer a solution to this limitation, but require expansion of their activity to extend the scope of this therapeutic strategy. BoNT B, BoNT D, and BoNT F LC proteases selectively hydrolyze vesicle associated membrane protein-1 (VAMP1) and VAMP2, thereby blocking neurotransmitter secretion. However, several other VAMP family members such as VAMP7 (TI-VAMP), mediate important cellular events including autophagy, plasma membrane remodeling, and secretion, but are not cleaved by BoNT proteases. VAMP7 is the primary v-SNARE responsible for MT1-MMP secretion during tumor cell invasion, and also mediates granzyme B and perforin secretion during natural killer mediated cell death, a major hurdle in transplantation efforts. Given its close relationship to natural BoNT substrates, VAMP7 represents an ideal first target for simultaneously expanding BoNT LC protease activity for biomacromolecular modulation of intracellular chemistry, and broadening the applications for targeted inhibitors of trafficking and secretion.

In addition to providing an engineered BoNT protease with potential therapeutic relevance, this example establishes a foundation for extending intracellular biological treatments using the BoNT platform.

Evolution of BoNTs Using PACE

Figures 4C, 4D:
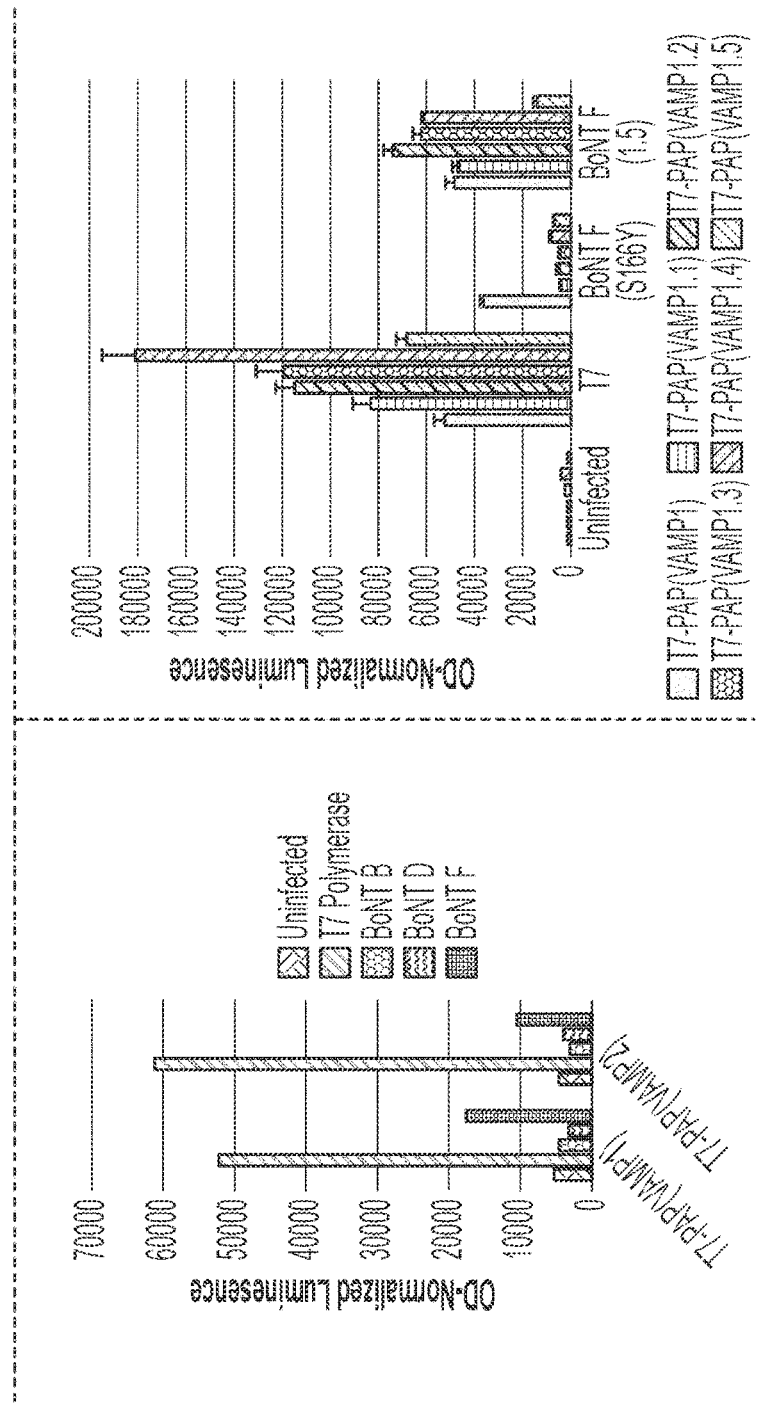

The first-generation T7-PAP construct possessed only a short (seven amino acid) substrate sequence, and was flanked by flexible linkers to allow T7 lysozyme binding in the unhydrolyzed state (FIG. 4B). However, this condensed cleavage sequence differs dramatically from the extended substrate recognition site in BoNT proteases. VAMP-cleaving BoNT proteases require a sequence of approximately 30 amino acids to perform efficient hydrolysis in isolated peptides, and thus it becomes essential to establish whether an elongated substrate sequence can be incorporated into the T7-PAP with retention of protease-dependent transcriptional activity. In order to validate expression and proteolytic activity of recombinantly expressed BoNT LC proteases (hereafter annotated to as BoNT N, where N denotes the neurotoxin serotype), selection phagemids containing each of the three VAMP1-cleaving BoNT serotypes (BoNT LC B, D, and F) were obtained. These proteases were assayed against VAMP1 and VAMP2-linked T7-PAP constructs (T7-PAP(VAMP1)/T7-PAP(VAMP2)) in a coupled luciferase assay (FIG. 4C). The resulting data demonstrate that BoNT F is expressed upon M13 phage infection of *E. coli*, and can drive protease-dependent transcription from the SNARE-derived T7-PAPs. Selection phage were then submitted to a PACE on the T7-PAPVAMP1 substrate, yielding a mutation (S166Y) that dramatically improves cleavage activity on the natural substrate (FIG. 4D, third column). These results demonstrate that PACE selection can be applied to BoNT protease evolution using a SNARE-protein adapted T7-PAP.

Previous characterization of BoNT F protease promiscuity has revealed a collection of residues in VAMP1 that are important for efficient cleavage activity, and a number of these sites coincide with non-conserved amino acids in VAMP7 (FIG. 4A). These residues (as shows in FIG. 4B) were selected as primary targets for assessing initial PACE trajectories for BoNT protease reprogramming. A panel of AP's encoding T7-PAPs containing VAMP1 single-mutant substrates for VAMP7-targeted evolution was produced, and the activity of BoNT F(wt) and the evolved BoNT F(S166Y) on these constructs was measured. Many of these single mutant substrates were efficiently cleaved using the more active BoNT F(VAMP1) evolved protease. The T7-PAP (VAMP71.1) AP, carrying the VAMP1(D58G) mutation, displays lower cleavage efficiency (FIG. 4D) and was targeted for subsequent PACE selection. After a 72h PACE positive selection, phage with dramatically enhanced cleavage activity (FIG. 4D) were selected. The selected variants carried a set of highly-enriched mutations: S166Y, R240L, and Y372H.

Negative Selection and Evolved Proteases that Cleave VAMP7

Figure 5:
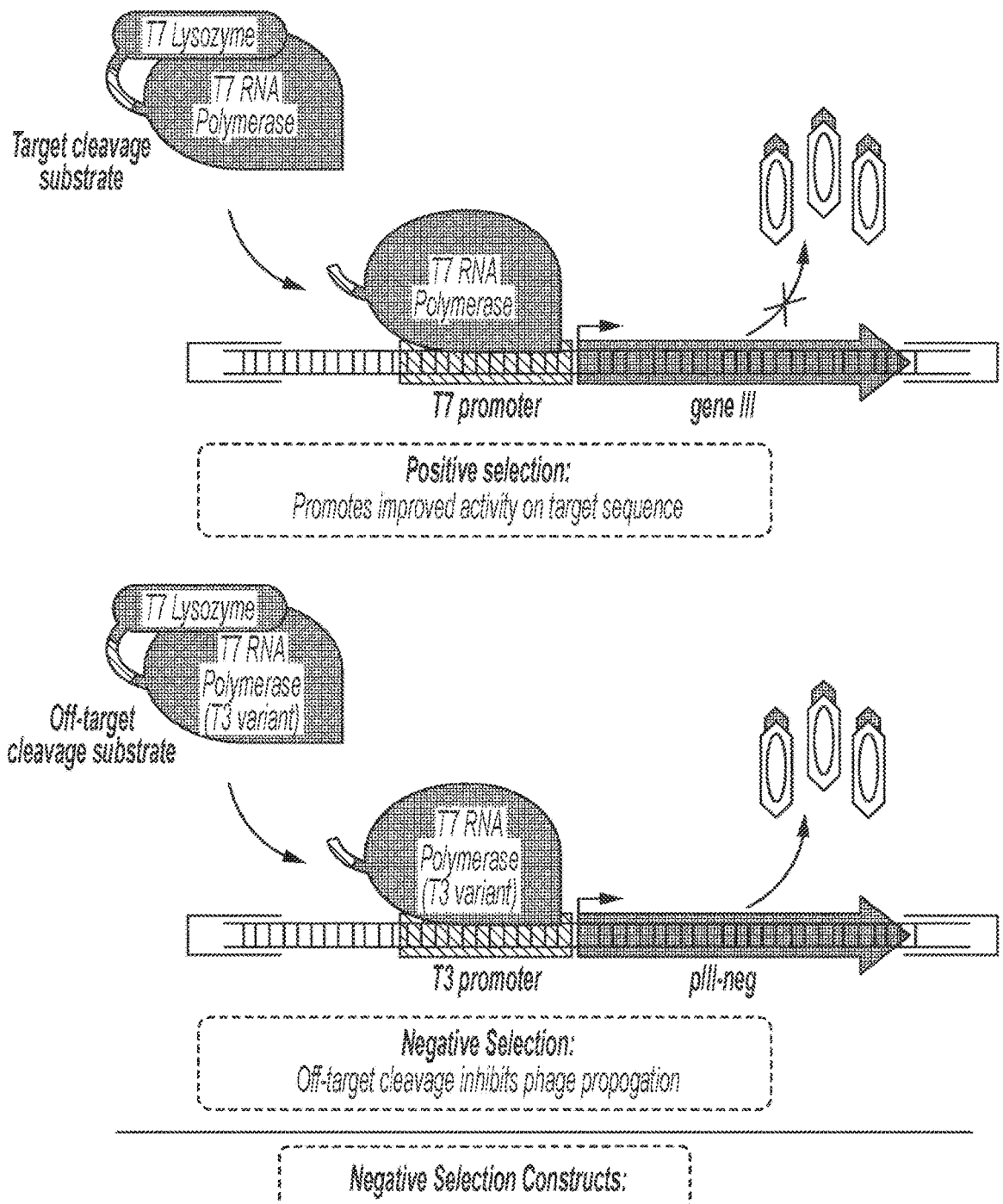
FIG. 5 is a schematic depicting an orthogonal polymerase strategy against unselective proteases, and examples of negative selection constructs. From top to bottom, sequences correspond to SEQ ID NOs: 334-337.

Because positive selection generally results in broadened activity with low specificity, it was important to develop a negative selection strategy to select for BoNT F proteases with high specificity for the desired VAMP7 sequence. Here, a modified T7 polymerase that selectively transcribes from the T3 polymerase target sequence was fused with T7 lysozyme to generate an orthogonal protease-activated polymerase (T3neg-PAP) and was coupled to expression of a dominant negative mutant of gene III, pIII-neg, upon cleavage by non-selective BoNT (e.g., a BoNT having an undesired proteolytic activity). Competitive expression of pIII-neg effectively suppresses phage propagation by generating phage incapable of infecting new hosts, and is initiated upon cleavage of an off-target sequence in the protease-sensitive linker of T3neg (FIG. 5). Because this gene cassette (containing the orthogonal polymerase and pIII-neg) are encoded on a separate plasmid, the concentration of substrate (T3neg) and the amount of pIII-neg produced per hydrolysis event can be modulated through plasmid copy number, promoter engineering, and ribosome binding sequence optimization of the resulting mRNA transcript. This allows for tunable negative selection stringency, and increases the likelihood that selective BoNT mutants can be enriched. Certain evolutionary trajectories between VAMP1 and VAMP7 cover a large number of non-natural SNARE protein sequences. Therefore, in order to obtain high specificity, negative selection against a only relatively small number of naturally-occurring off-target substrates will be performed. In some embodiments, a VAMP1-linked T3neg-PAP selects against the most likely off-target substrate for the evolved protease. Additional in vitro substrate profiling can be performed using related SNARE proteins such as VAMP2, VAMP3, and VAMP8 to ensure a high degree of specificity for the target VAMP7.

Characterization of Evolved BoNT Proteases

The chemical and biological properties evolved BoNT proteases are investigated. Recombinant expression and isolation of BoNT F LC proteases was performed and is sufficient to obtain material for in vitro cleavage assays. Single-mutant reversions of the evolved BoNT proteases are assayed to interrogate their role in controlling enzymatic activity and specificity. SNARE substrate cleavage is assayed by both gel electrophoresis and LC/MS to determine enzyme kinetics. Stability (both thermal and proteolytic) of the evolved protease is assessed in quantitative assays. The therapeutic potential of BoNT variants to bring about selective membrane fusion blockade by cleaving VAMP7 is investigated by characterizing the ability of the variants to function as targeted secretion inhibitors in human cells, for example using the MT1-MMP secretion model. Briefly, BoNT protease variant is introduced into MDA-MB-231 breast cancer cells via transfection, and extracellular matrix degradation is assayed using a fluorescent gelatin plating medium. Transwell migration assays are also performed; siRNA and anti-VAMP7 antibody data are compared with BoNT activity to determine the relative potency of BoNT protease variant treatment. Surface labeling with anti-MT1-MMP antibodies is also performed as an orthogonal assay for VAMP7 function in this invasion assay.

Example 2

PACE of BoNT Protease Variants

Figure 6A:
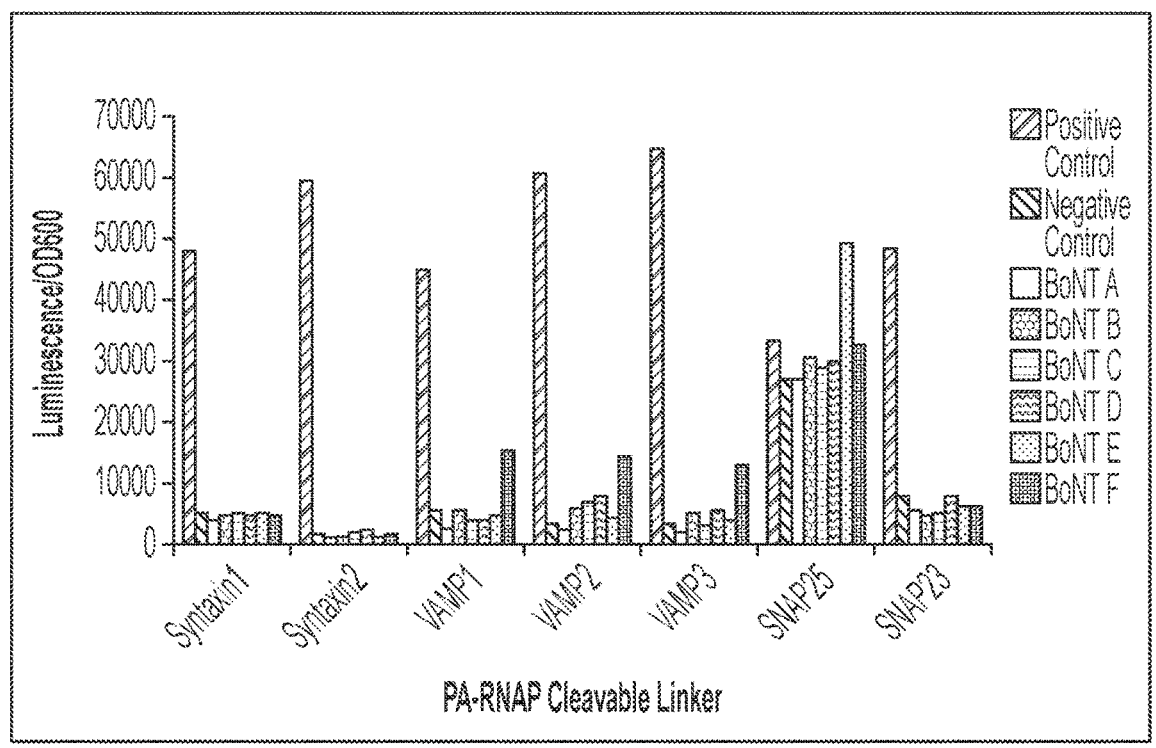
FIGS. 6A-6B show proteolytic activity of BoNT proteases.
Figure 6B:
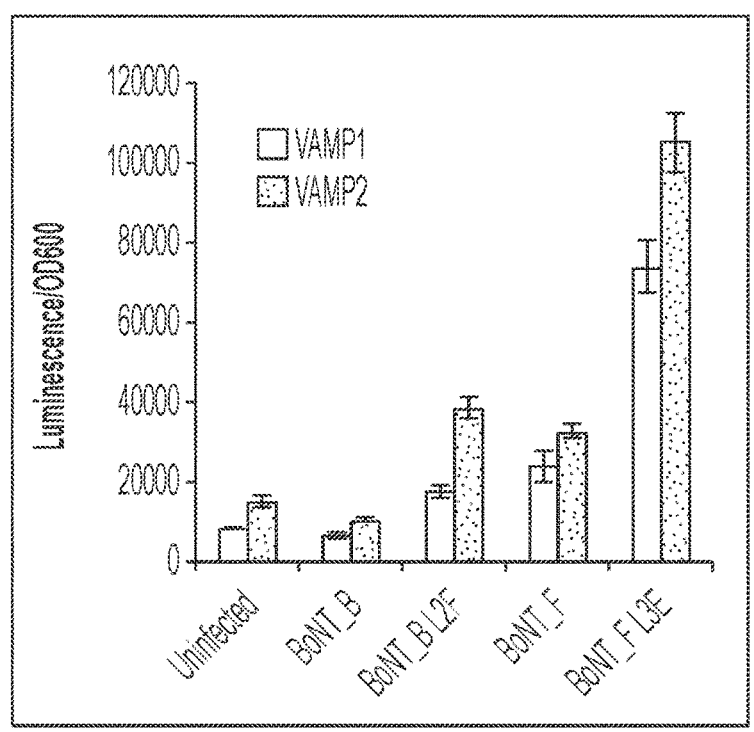

In contrast to previous selections, where protease activity and selectivity is dictated by a short (approximately 7 amino acid) peptide sequence, BoNT LC serotypes recognize an extended sequence of their cognate SNARE protein substrates. Data indicate that a 60 amino acid fragment of VAMP1, extending from residues 28-87, serves as a suitable linker between T7 RNAP and T7 lysozyme, affording up to 3-fold activation of the polymerase upon proteolytic cleavage (FIG. 6A). Notably, BoNT serotypes B and F perform best on this substrate in accord with their in vivo activity, while other BoNT LC serotypes exhibit PA-RNAP activation exclusively for their cognate substrates (BoNT E on SNAP25). The VAMP1 PA-RNAP has been shown to be sufficient to carry out PACE selection, and has yielded BoNT B and BoNT F variants with increased apparent VAMP1 and VAMP2 cleavage activity (FIG. 6B).

Figure 7:
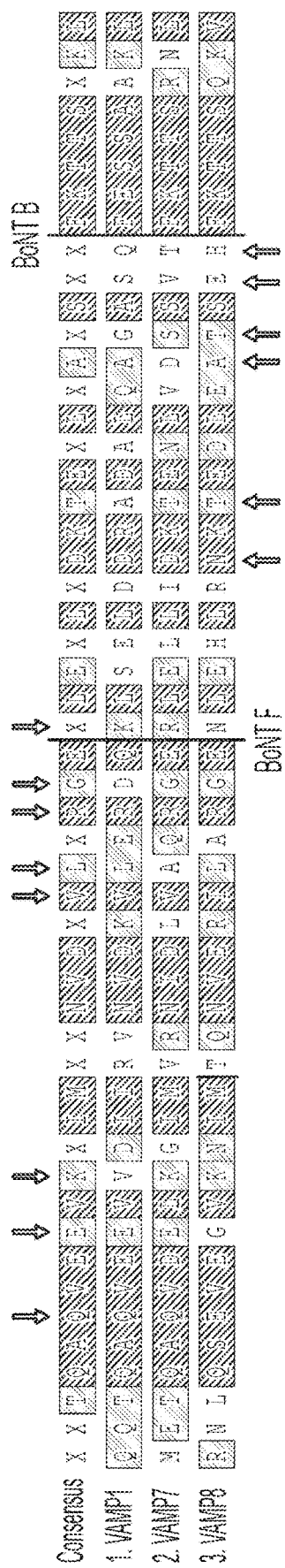
FIG. 7 shows a primary sequence alignment of VAMP1, VAMP7, and VAMP8. The BoNT LC cleavage sites for serotypes B and F are marked on the bottom and top, respectively. Residues marked with an arrow lead to a decrease in cleavage activity by at least 50% on VAMP2 upon removal of the residue side chain. From top to bottom, sequences correspond to SEQ ID NOs: 338-341.

The efficiency of PACE makes practical a stepping-stone approach in which a protein evolves recognition of a successively altered series of substrates towards a dramatically altered final substrate. Alignment of VAMP1, VAMP7, and VAMP8 shows a high degree of sequence homology, but notable deviation in activity-promoting residues for both the BoNT B and BoNT F serotypes (see FIG. 6B, BoNT B L2F and BoNT F L3E, and FIG. 7). Evolutionary pathways were designed that gradually evolve wild-type protease specificities by successive introduction of each amino acid substitution (or set of substitutions) in the VAMP7/8 target sequences into the VAMP1 PA-RNAP, followed by PACE selection on the resulting AP construct. This strategy allows a stepwise accumulation of LC mutations that result in a gradual shift in protein activity toward the desired VAMP substrates.

Figure 8:
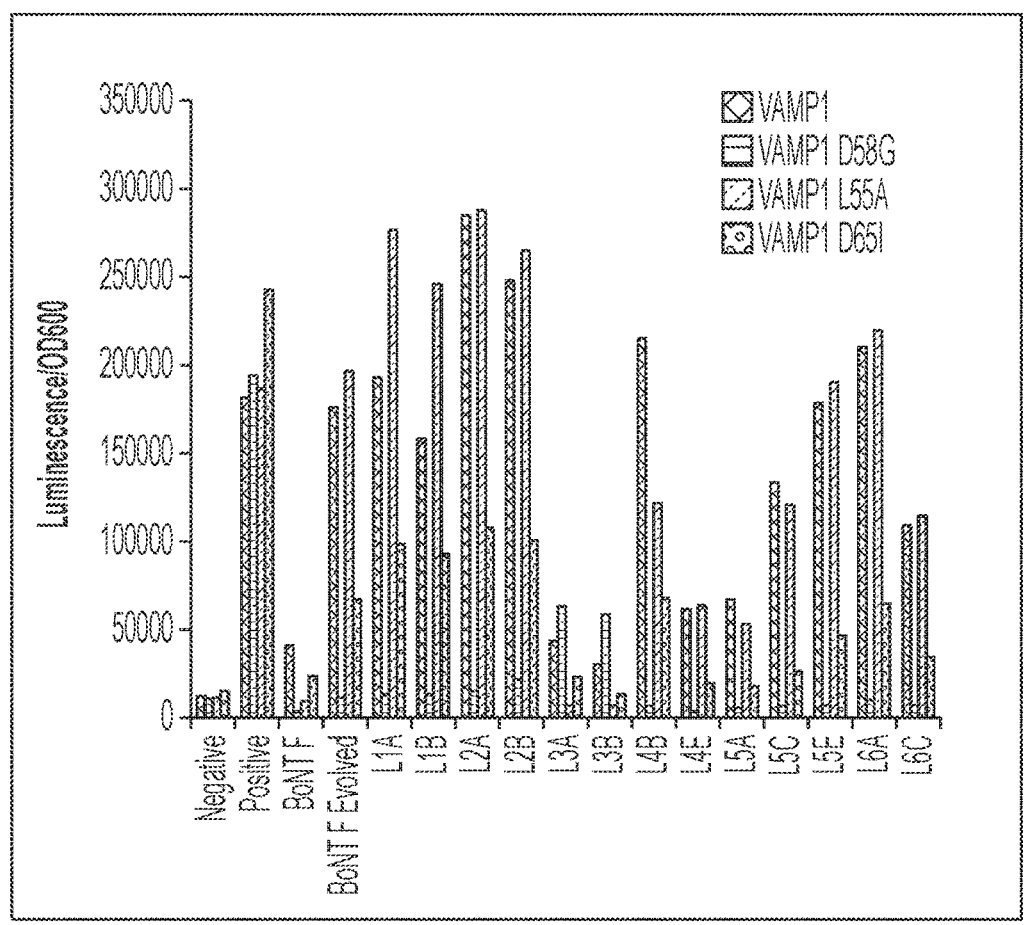
FIG. 8 shows evolved BoNT F variants displaying varied activity on a collection of VAMP1 single residue mutants. L1/L2 were evolved to cleave VAMP1 L55A, L3/4 were evolved to cleave VAMP1 D58G, and L5/L6 were evolved to cleave VAMP1 D65I.

As a means for interrogating the baseline promiscuity and potential evolutionary trajectories for BoNT B and F LCs, a panel of single-residue mutants in the VAMP1 PA-RNAP in which the native VAMP1 residue has been converted into the corresponding VAMP7 or VAMP8 residue were assayed. Data indicate that BoNT F LC tolerates many of the individual VAMP7 substitutions, however three of these substitutions (VAMP1 L55A, D58G, and D65I) attenuated the protease-dependent luciferase signal. Particularly difficult substitutions such as these were targeted first, in order to enter challenging selections from wild-type activity levels. Separate PACE selection for cleavage of each these mutant substrates have yielded evolved variants with improved activity against the respective mutant substrate, indicating that the designed PA-RNAP constructs facilitate evolution of BoNT proteases (FIG. 8). Importantly, the ease with which new PA-RNAP constructs can be developed, and the efficiency of PACE selection enable multiple evolutionary pathways to be interrogated in parallel, thereby increasing the probability of success. For example, each of the evolved BoNT F variants in FIG. 8 represents a different evolutionary trajectory that can be carried forward to access new substrates with increased similarity to VAMP7.

Example 3

Evolution of BoNT F by PACE

Figure 9:
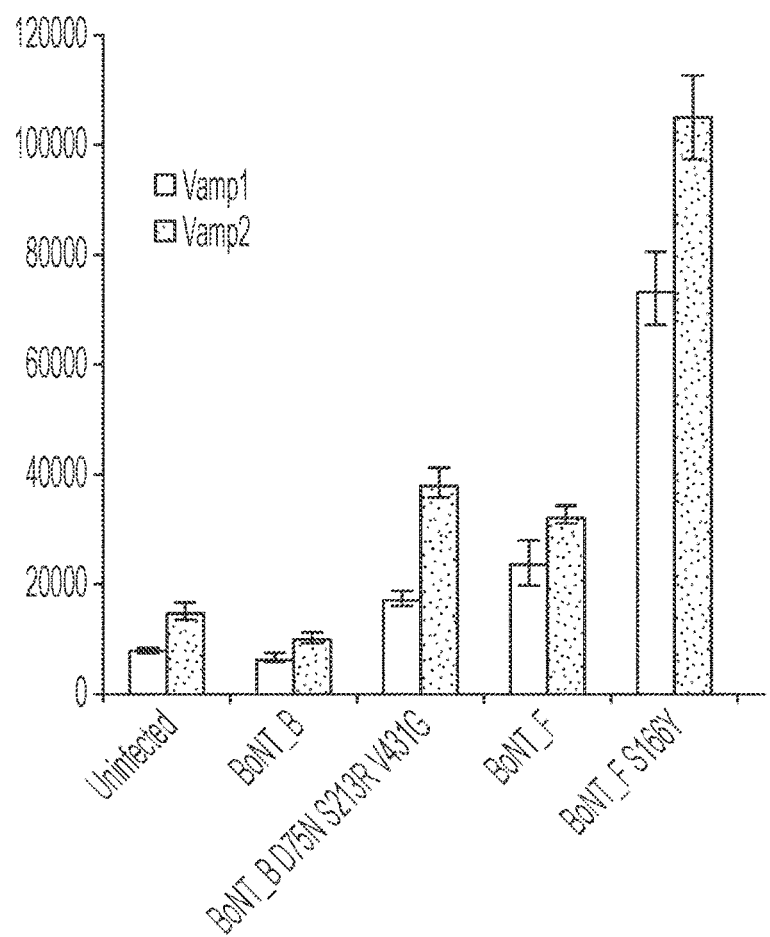
FIG. 9 shows luciferase assay data indicating that BoNT B and BoNT F can be evolved to cleave VAMP1/2.
Figure 10:
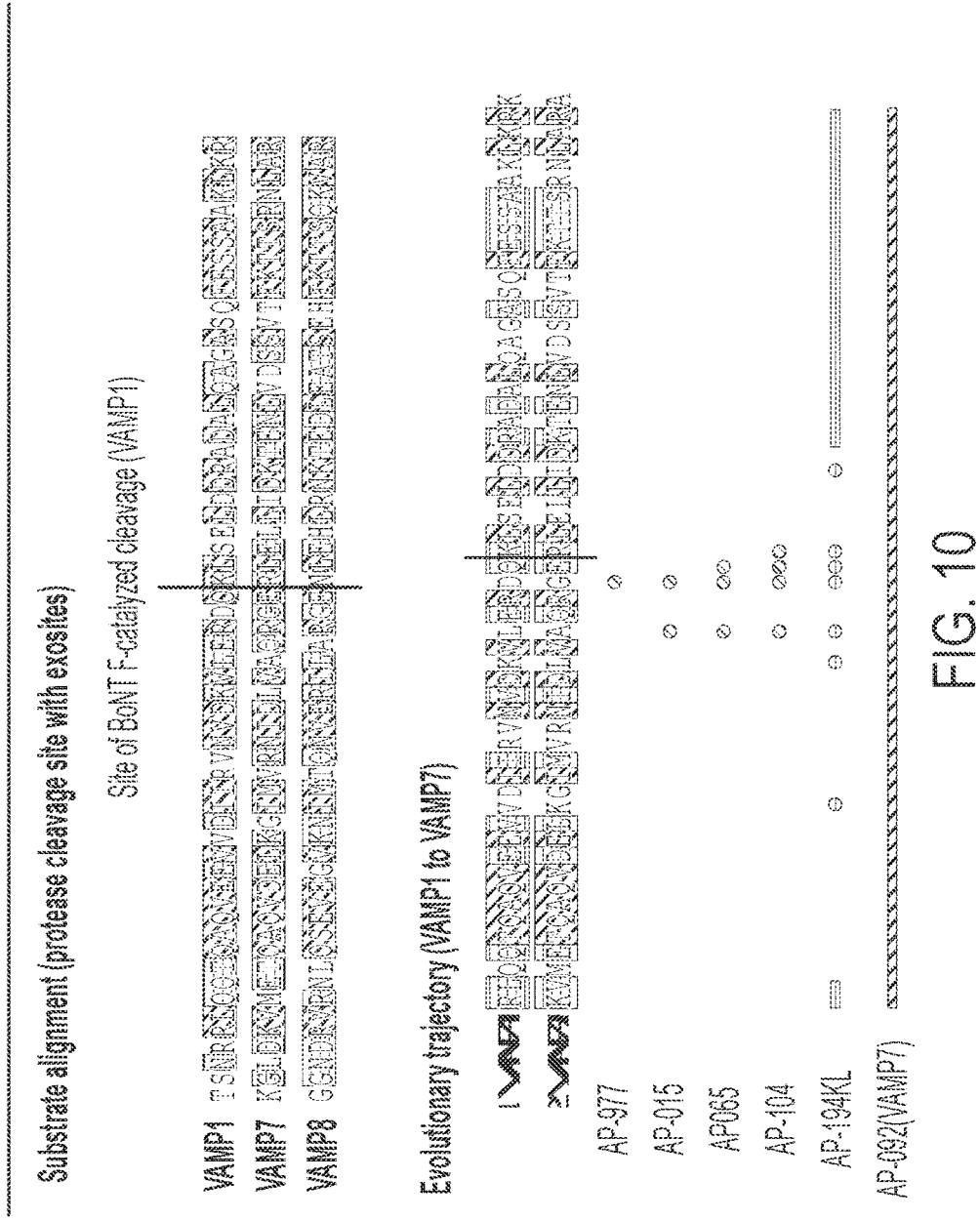
FIG. 10 shows an alignment of the amino acid sequences of VAMP1, VAMP7 and VAMP8 (top) and an example of a VAMP1 to VAMP7 evolutionary trajectory (bottom). AP: accessory plasmid. From top to bottom, sequences correspond to SEQ ID NOs: 342-346.

First-pass PACE evolution was performed on BoNT serotypes B, D, and F. Luciferase assay data indicates that BoNT B and BoNT F can be evolved to alter protease activity, for example to increase cleavage of the native VAMP1/2 substrate (FIG. 9). FIG. 10 shows one example of an evolutionary trajectory for VAMP1 to VAMP7 cleaving proteases and examples of accessory plasmids for achieving the same.

Figure 11:
FIG. 11 shows an alignment of BoNT F and BoNT B VAMP2 (a natural substrate) cleavage domains with VAMP7. From top to bottom, sequences correspond to SEQ ID NOs: 347-349.
Figure 12:
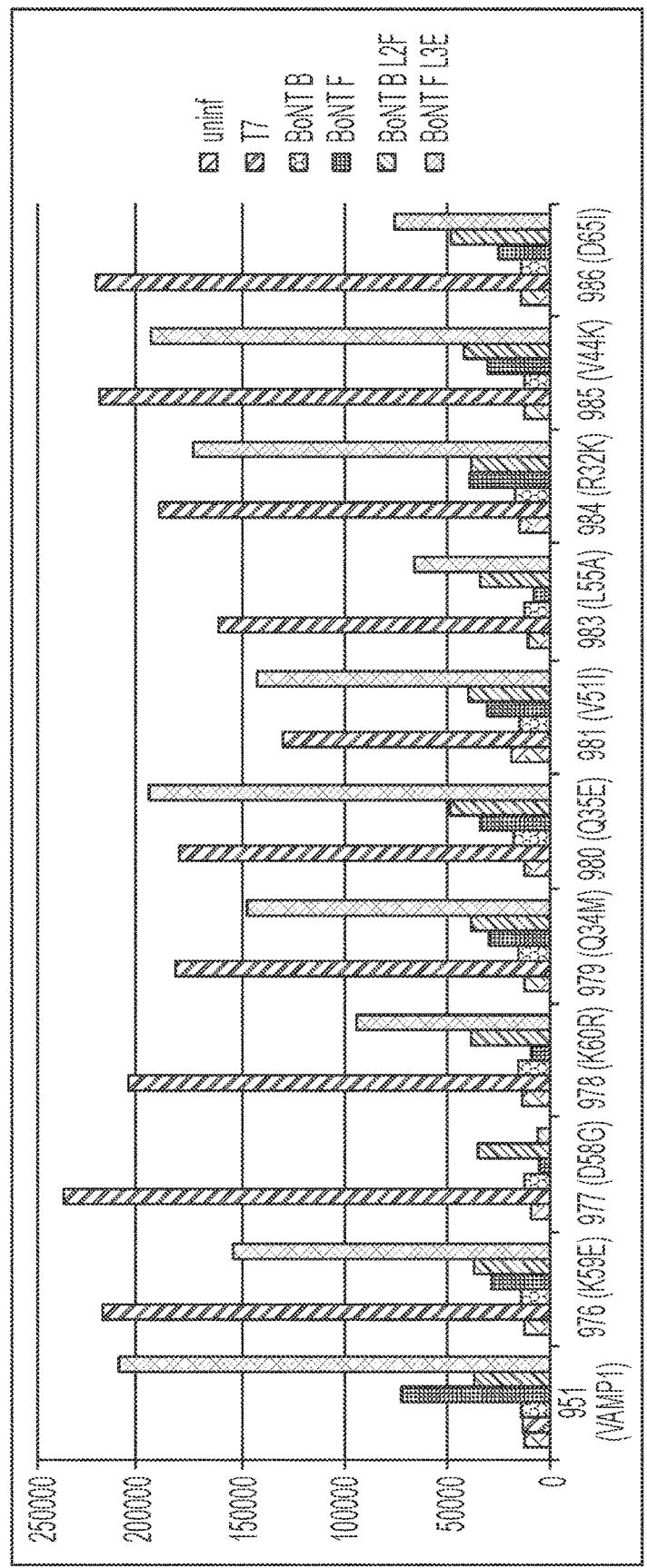
FIG. 12 shows data indicating that evolution of BoNT B and F by PACE (e.g., using AP's 977, 983 and 986 for BoNT F) resulted in BoNT variants with improved activity.
Figures 13, 14:
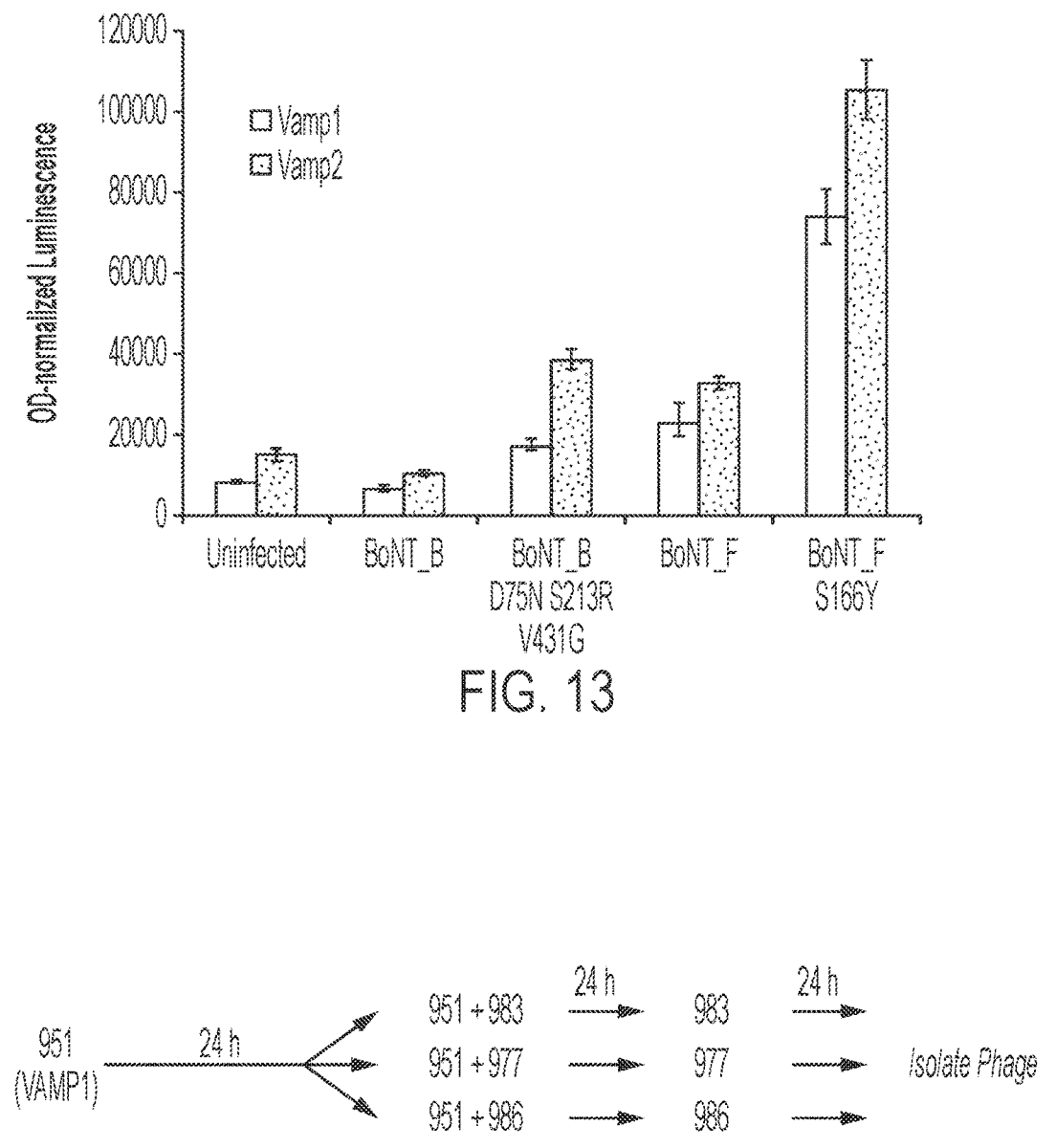

VAMP7 participates in phagocytosis, mitosis, cell migration, membrane repair and growth. FIG. 11 depicts an alignment of BoNT F and BoNT B VAMP2 (a natural substrate) cleavage domains with VAMP7. FIG. 12 provides data indicating that evolution of BoNT B and F by PACE (e.g., using AP's 977, 983 and 986 for BoNT F) resulted in BoNT variants with improved activity. FIG. 13 shows representative data relating to validation of BoNT Light Chain (LC) selection; data indicate that evolution of BoNT F protease on VAMP1 enriches for the S166Y mutation, which confers broadly increased activity. Evolution of BoNT F (S166Y) on AP-977 also enriches strongly for mutations at position 240, which directly contacts the altered substrate residue (D→G).

FIG. 14 shows one example of a stepping-stone evolutionary pathway for production of BoNT F variants that cleave VAMP7. FIG. 15 shows protease activity assays for BoNT F variants from three different experiments (Lagoons 1-6). Each experiment produced a different single mutant variant (L55A, D58G, D65I). Lagoons 1-4 were carried forward for PACE experiments using a double mutant substrate (AP-015: L55A/D58G) AP.

Figure 17:
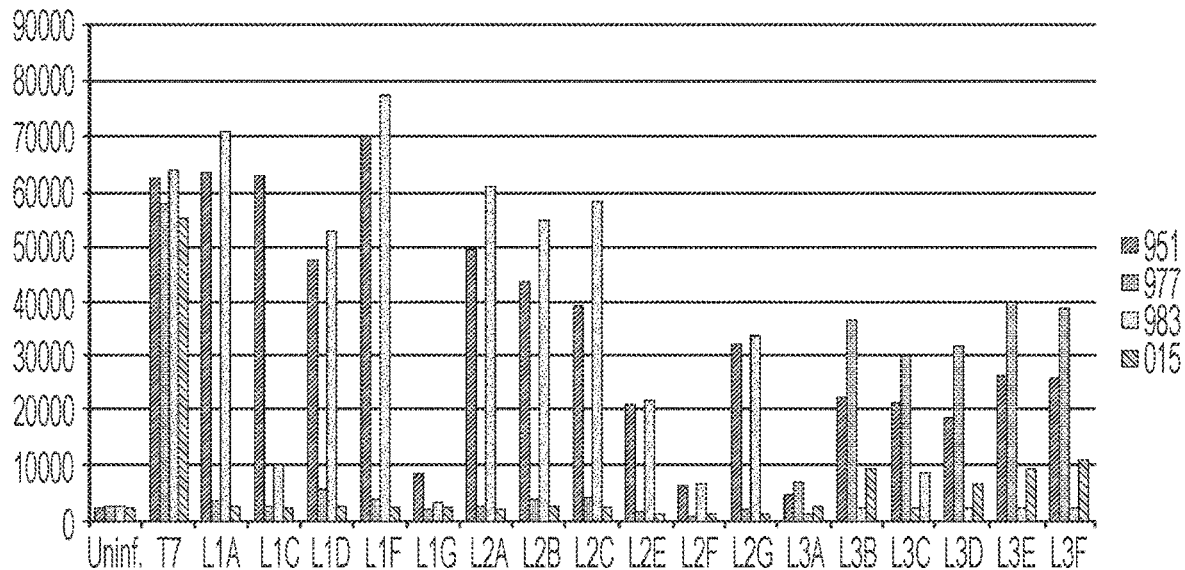
FIG. 17 shows protease-dependent luciferase assay data indicating that certain BoNT F variants produced by PACE can cleave the double mutant VAMP1 substrate (L55A/D58G).

FIG. 16 shows a schematic depiction of double mutant PACE experiments to evolve BoNT F; the amino acid sequence of the double mutant VAMP1 (LSSA/D58G) is also shown. Protease-dependent luciferase assay data indicate that BoNT F variants that cleave the double mutant VAMP1 substrate were produced by PACE (FIG. 17).

Figure 18:
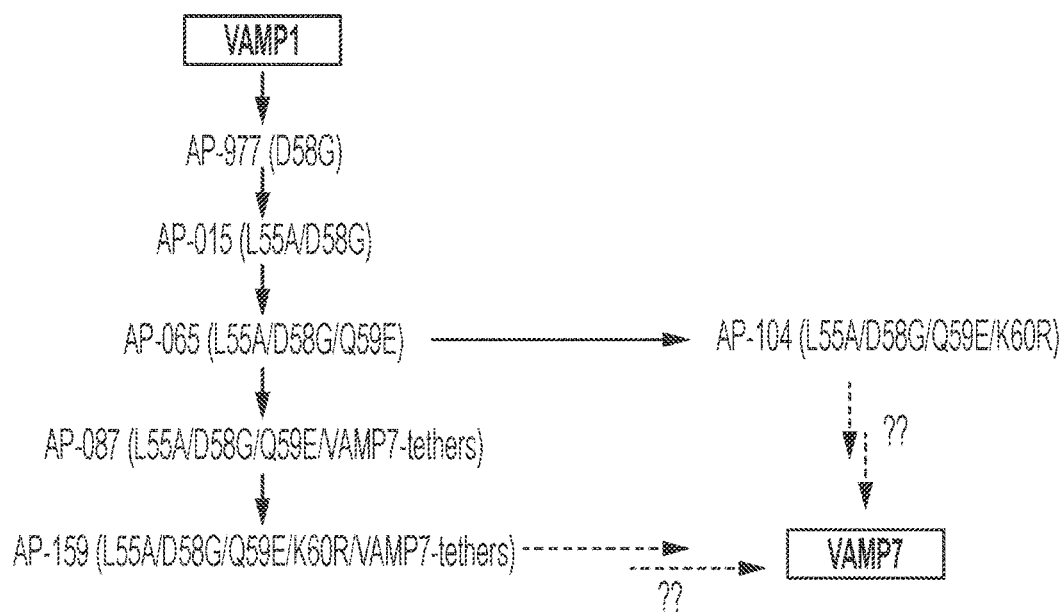
FIG. 18 shows one example of a VAMP1-VAMP7 stepping stone evolutionary trajectory. From top to bottom, sequences correspond to SEQ ID NOs: 350-351.
Figure 19:
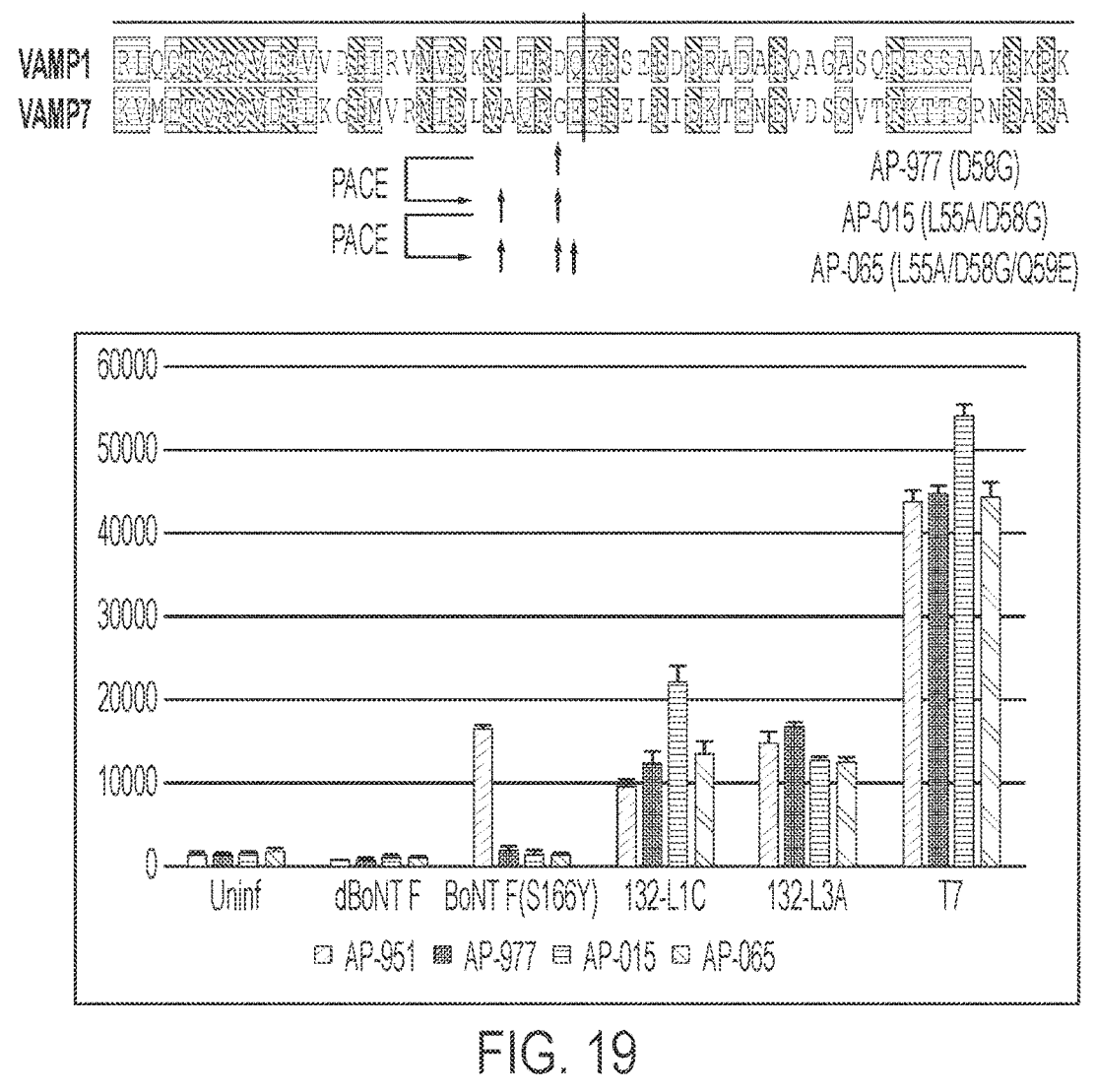

FIG. 18 shows one example of an evolutionary "stepping stone" strategy for mutation of BoNT F to cleave VAMP7. FIG. 19 shows representative data for triple mutant (L55A/D58G/Q59E) selection of BoNT F variants. Data indicate that variants L132-L1C and L132-L3A cleave VAMP1 containing three VAMP7 mutations (L55A/D58G/Q59E).

Figure 20:
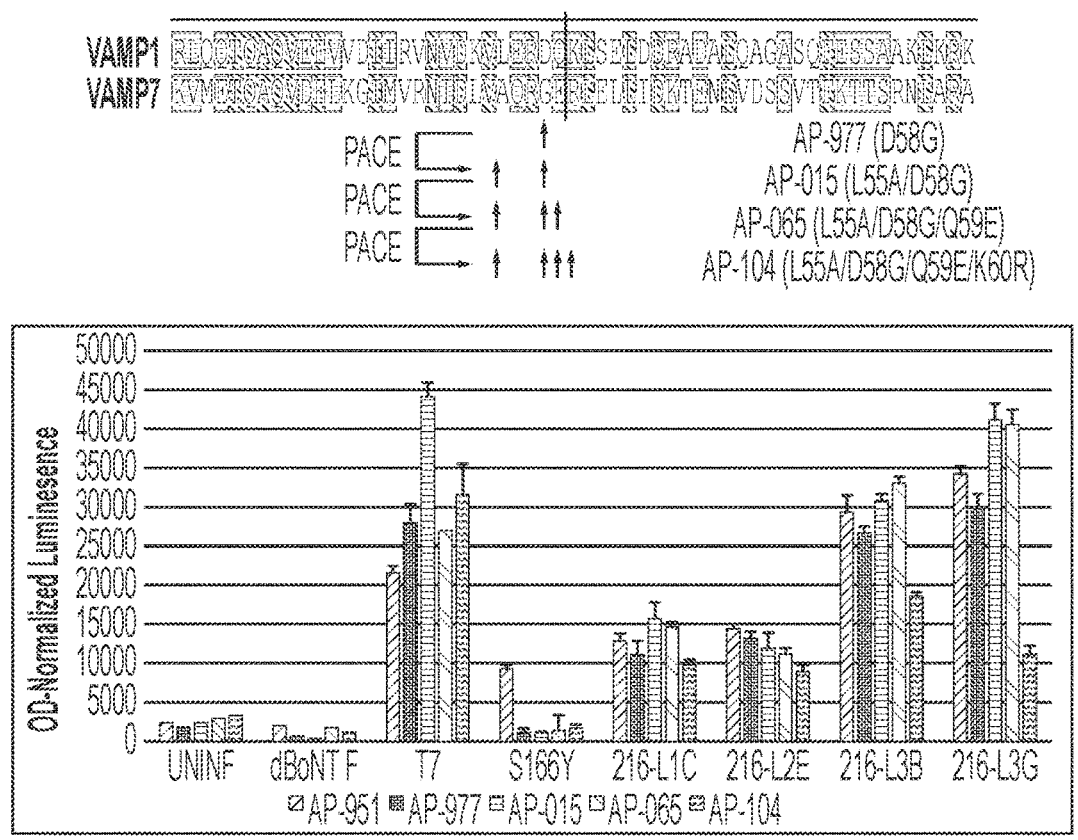
FIG. 20 shows protease-dependent luciferase assay data indicating that certain BoNT F variants produced by PACE can cleave the triple mutant VAMP1 substrate (L55A/D58G/Q59E/K60R). From top to bottom, sequences correspond to SEQ ID NOs: 350-351.
Figure 21:
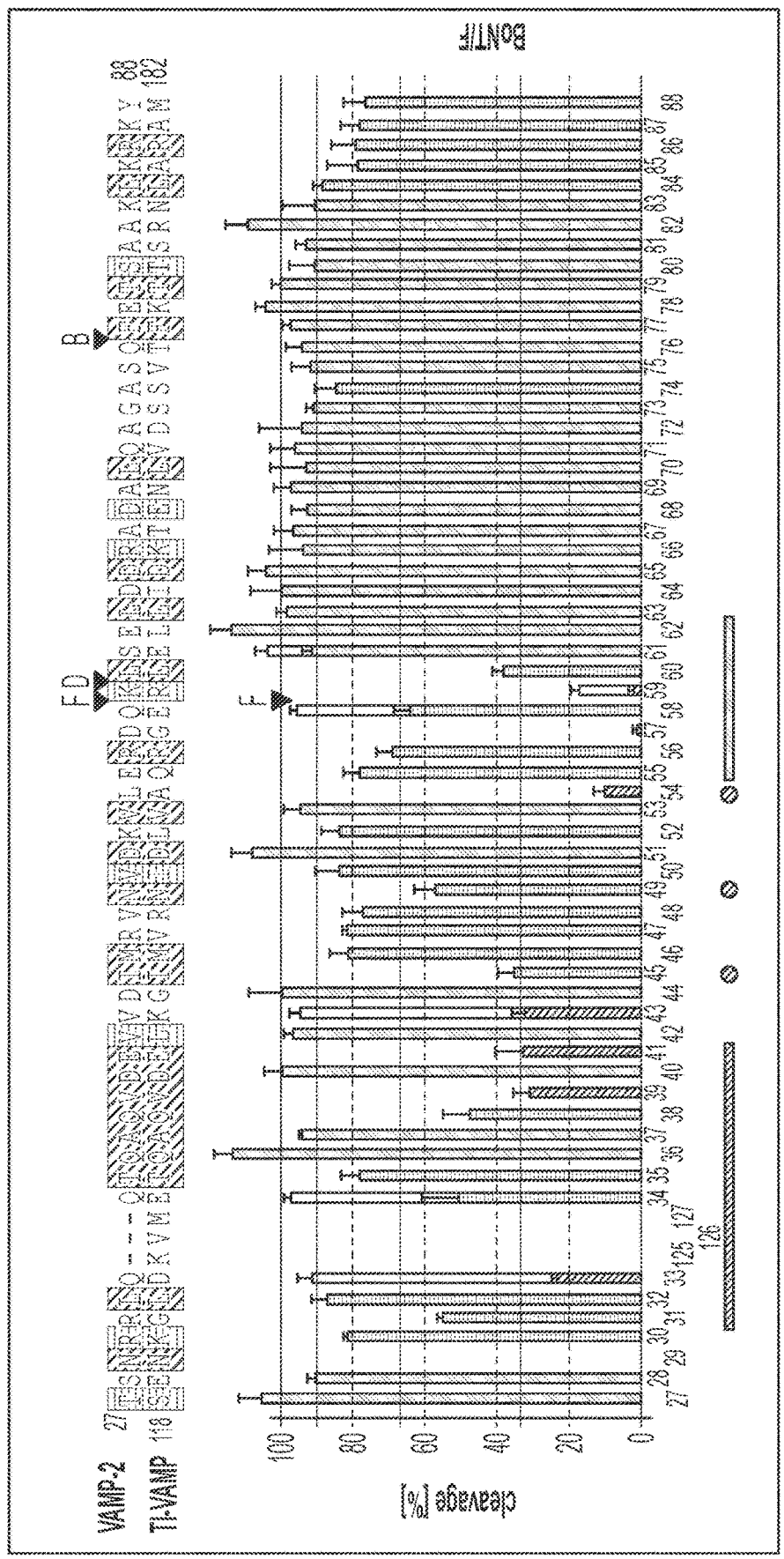
FIG. 21 shows data indicating that the activity of proteases on VAMP1 substrates containing mutations V44K (shown as V43 in the figure) and Q32M (shown as Q33 in the figure) can be readily evolved. From top to bottom, sequences correspond to SEQ ID NOs: 352-353.

FIG. 20 shows representative data for tetramutant (L55A/D58G/Q59E/K60R) selection of BoNT F variants. It was observed that several selected BoNT F variants (e.g., 216-L1C, 216-L1E, 216-L3B, 216-L3G) cleave the VAMP1 containing four VAMP7 mutations (L55A/D58G/Q59E/K60R), indicating that four of the five least permissive mutation sites in VAMP1 have been addressed. FIG. 21 shows that activity of proteases on V44K (shown as V43 in the figure) and Q32M (shown as Q33 in the figure) can be readily evolved. BoNT F proteases tolerant of VAMP7 termini have also been observed.

Figure 22:
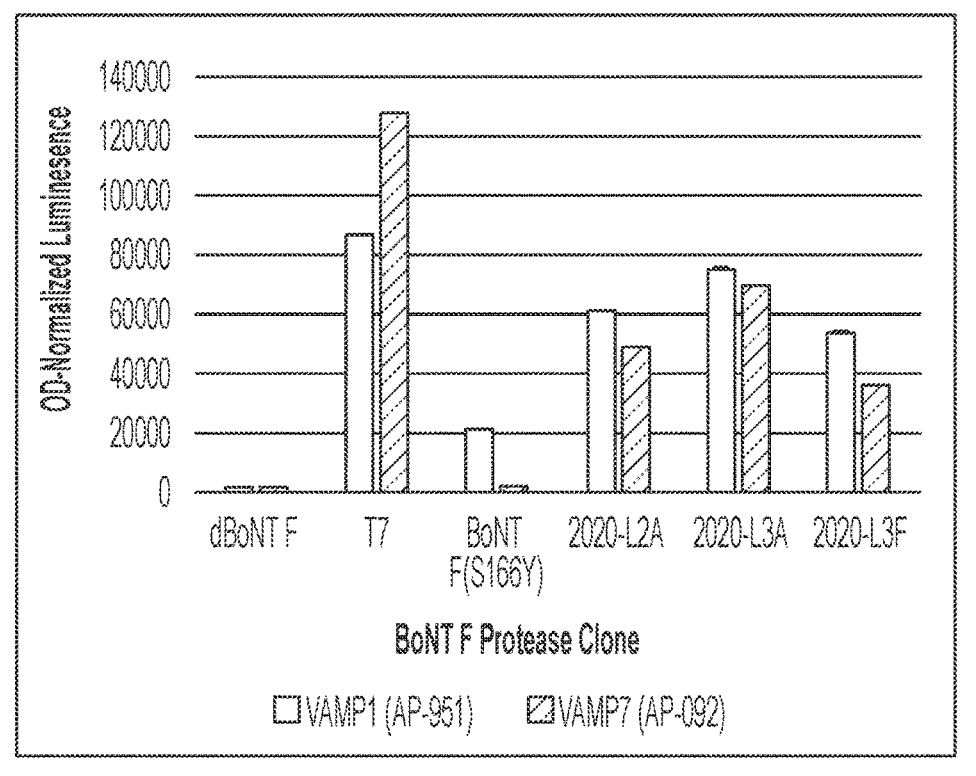
Figure 23:
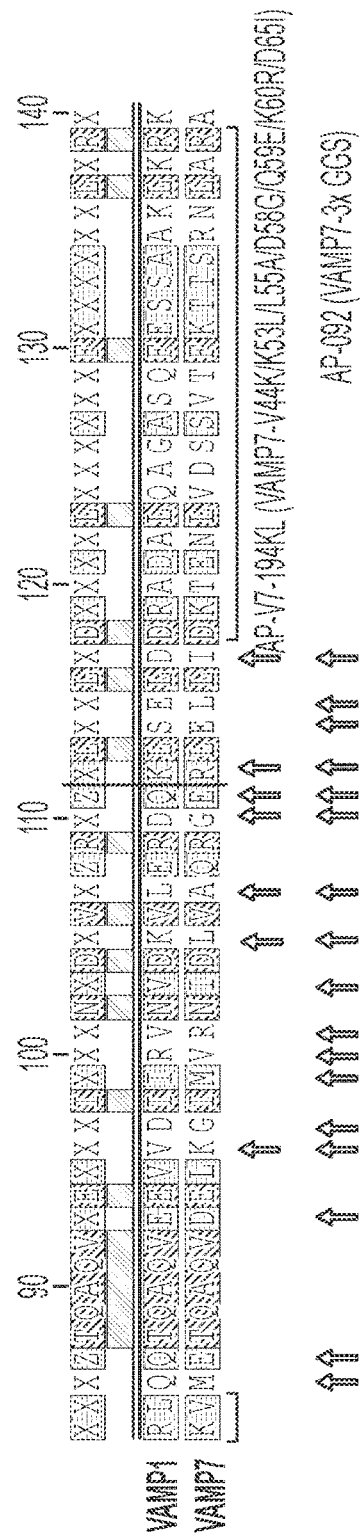
FIG. 23 shows an alignment of VAMP1 and VAMP7 amino acid sequences, along with AP-V7-194KL, which contains seven VAMP7 mutations (V44K/K53L/L55A/D58G/Q59E/K60R/D65I). From top to bottom, sequences correspond to SEQ ID NOs: 354, 350, and 351.

Iterative selection on progressively more complex VAMP substrates afforded several BoNT F variants that cleave VAMP7 (FIG. 22). FIG. 23 shows an alignment of VAMP1 and VAMP7 amino acid sequences, along with AP-V7-194KL, which contains seven VAMP7 mutations (V44K/K53L/L55A/D58G/Q59E/K60R/D65I). Table 3 below shows mutations observed in several BoNT F variants after PACE with AP-V7-194KL for 48 h, followed by AP-V7-194KL+AP-092 for 24 hours, followed by AP-092 for 48 hours.

TABLE 3

| L1 | a | E66D | | S166Y | D175G | N184K | E200G | |
| | b | E66D | | S166Y | D175G | N184K | E200G | Y210H |
| | c | E66D | | S166Y | D175G | N184K | E200G | |
| | d | E66D | | S166Y | D175G | N184K | E200G | |

TABLE 3-continued

| | | | | | | | | | | |
|---|---|---|---|---|---|---|---|---|---|---|
| | e | | | | S166Y | D175G | N184K | | E200G | T214I |
| | f | E66D | | | S166Y | D175G | N184K | | E200G | |
| | g | E66D | | | S166Y | D175G | N184K | | E200G | |
| | h | E66D | | | S166Y | D175G | N184K | | E200G | |
| L2 | a | | | V106A | S166Y | S167I | | | E200G | |
| | b | | | V106A | S166Y | S167I | | | E200G | |
| | c | | | V106A | S166Y | S167I | | | E200G | |
| | d | | N76D | V106A | S166Y | S167I | | | E200G | |
| | e | | | V106A | S166Y | S167I | | | E200G | |
| | f | | | V106A | S166Y | S167I | | | E200G | |
| | g | | | V106A | S166Y | S167I | | | E200G | |
| | h | | | V106A | S166Y | S167I | | | E200G | |
| L3 | a | | | | S166Y | | N184K | | E200G | |
| | b | | | | S166Y | | N184K | | E200G | |
| | c | | | | S166Y | | N184K | | E200G | |
| | d | | | | S166Y | | N184K | Y199H | E200G | |
| | e | | | | S166Y | | N184K | | E200G | |
| | f | | | | S166Y | | N184K | | E200G | |
| | g | | | | S166Y | | N184K | | E200G | |
| | h | S70F | | E164K | S166Y | | N184K | | E200G | |

| | | | | | | | | | |
|---|---|---|---|---|---|---|---|---|---|
| L1 | a | | S224I | R240F | | R303H | P309T | | F360L |
| | b | | S224I | R240F | | | | | F360L |
| | c | | S224I | R240F | | | | | F360L |
| | d | E215G | | R240L | | | | | F360L |
| | e | | S224I | R240F | | | | | F360L |
| | f | | S224I | R240F | | | | | F360L |
| | g | | S224I | R240F | | | | | F360L |
| | h | E215G | | R240L | Y244C | | | | F360L |
| L2 | a | | S224I | R240L | | | | S350G | F360L |
| | b | | S224I | R240L | | | | S350G | F360L |
| | c | | S224I | R240L | | | | S350G | F360L |
| | d | | S224I | R240L | | | | S350G | F360L |
| | e | | S224I | R240L | | | | S350G | F360L |
| | f | | S224I | R240L | | | | S350G | F360L |
| | g | | S224I | R240L | | | | S350G | F360L |
| | h | | S224I | R240L | | | | S350G | F360L |
| L3 | a | | S224I | R240F | | | | T335S | F360L |
| | b | | S224I | R240F | | N276T | | T335S | F360L |
| | c | | S224I | R240F | | | | T335S | F360L |
| | d | | S224I | R240F | | | | T335S | F360L |
| | e | | S224I | R240F | | | | T335S | F360L |
| | f | | S224I | R240F | A258S | N276S | | | F360L |
| | g | | S224I | R240F | | | | T335S | F360L |
| | h | | S224I | R240F | | | | | F360L |

| | | | | | | | | |
|---|---|---|---|---|---|---|---|---|
| L1 | a | | Y372H | | P410L | | 420(AWLRKS*) | |
| | b | | Y372H | | P410L | | 420(AWLRKS*) | |
| | c | | Y372H | | P410L | | 420(AWLRKS*) | |
| | d | K371E | Y372H | | P410L | | 420(AWLRKS*) | |
| | e | | Y372H | | P410L | | 420(AWLRKS*) | |
| | f | | Y372H | | P410L | | 420(AWLRKS*) | |
| | g | | Y372H | | P410L | | 420(AWLRKS*) | |
| | h | K371E | Y372H | | P410L | | 420(AWLRKS*) | |
| L2 | a | | Y372H | | N396H | P410L | 420(AWLRKS*) | |
| | b | | Y372H | | N396H | P410L | 420(AWLRKS*) | |
| | c | | Y372H | | N396H | P410L | 420(AWLRKS*) | |
| | d | | Y372H | | N396H | P410L | 420(AWLRKS*) | |
| | e | | Y372H | | N396H | P410L | 420(AWLRKS*) | |
| | f | | Y372H | | N396H | P410L | 420(AWLRKS*) | |
| | g | | Y372H | | N396H | P410L | 420(AWLRKS*) | |
| | h | | Y372H | | N396H | P410L | 420(AWLRKS*) | |
| L3 | a | | Y372H | | N396H | P410L | D418Y | E423K |
| | b | | Y372H | | N396H | P410L | D418Y | E423K |
| | c | | Y372H | | N396H | P410L | D418Y | E423K |
| | d | | Y372H | | N396H | P410L | D418Y | E423K |
| | e | | Y372H | | N396H | P410L | D418Y | E423K |
| | f | | Y372H | L375R | N396H | P410L | | E423K |
| | g | | Y372H | | N396H | P410L | D418Y | E423K |
| | h | | Y372H | L375R | N396H | P410L | | E423K |

Figure 24:
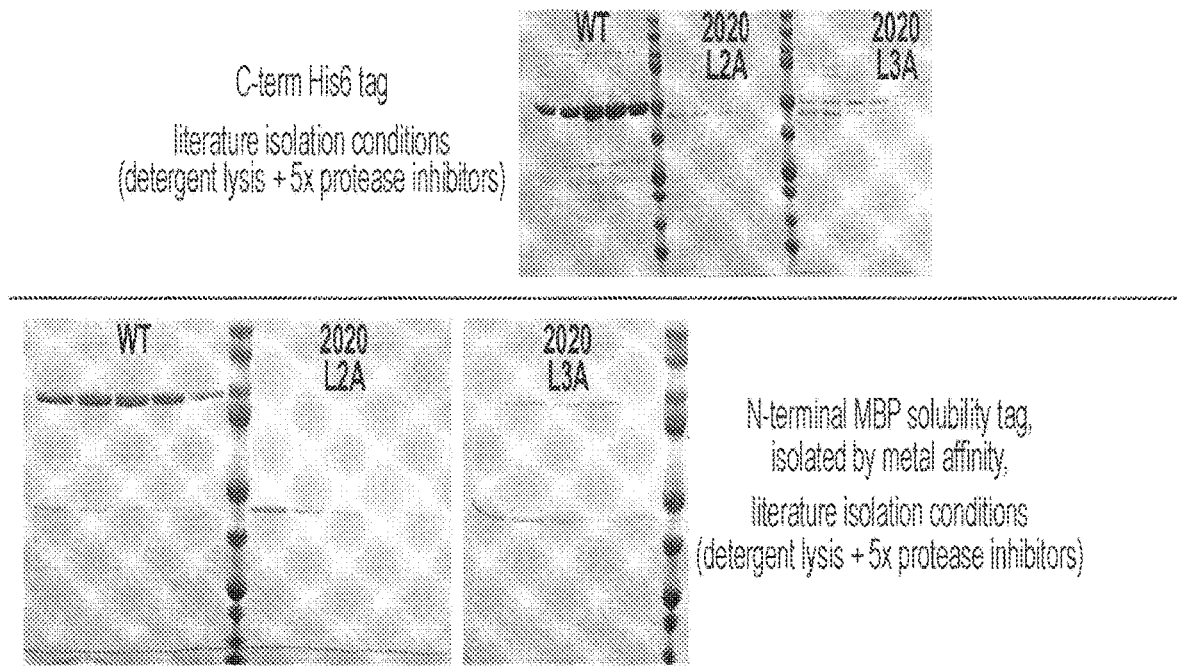
FIG. 24 shows protein blot analysis for protein expression of two BoNT F evolved variants (2020 L2A, 2020 L3A).

Several VAMP7-cleaving BoNT F variants were expressed in vitro. FIG. 24 shows protein blot analysis for protein expression of two BoNT F evolved variants (2020 L2A, 2020 L3A).

Figure 25:
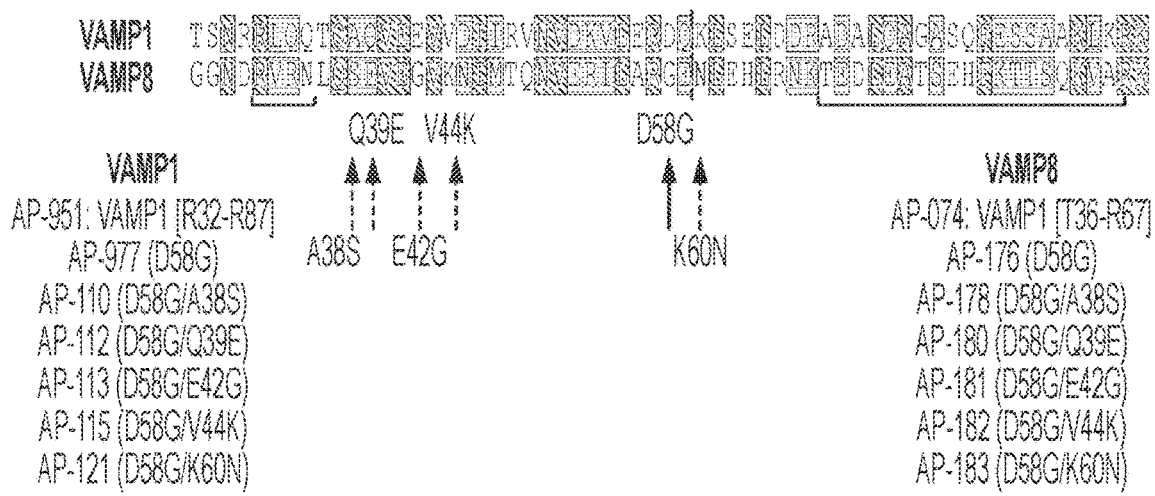
FIG. 25 is a schematic diagram of an alignment of VAMP1 and VAMP8 amino acid sequences and double mutant accessory plasmids (APs). From top to bottom, sequences correspond to SEQ ID NOs: 355-356.
Figure 26:
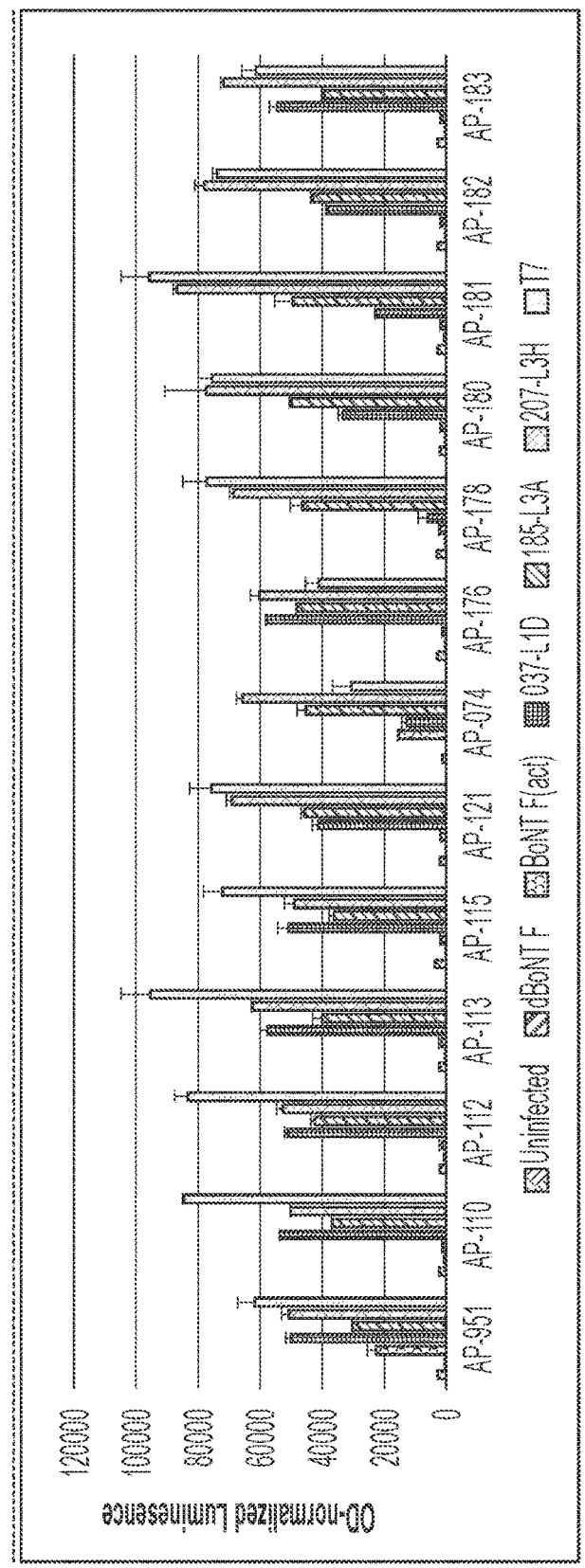
FIG. 26 shows representative data that indicates VAMP7-evolved BoNT F proteases have a broadened activity profile.

VAMP7-evolved proteases were then used to screen a VAMP8 double mutant substrate panel. FIG. 25 shows a schematic diagram of an alignment of VAMP1 and VAMP8 amino acid sequences and double mutant accessory plasmids (APs) used in the screen. Data indicates that VAMP7-evolved BoNT F proteases have a broadened activity profile (FIG. 26).

Figure 27:
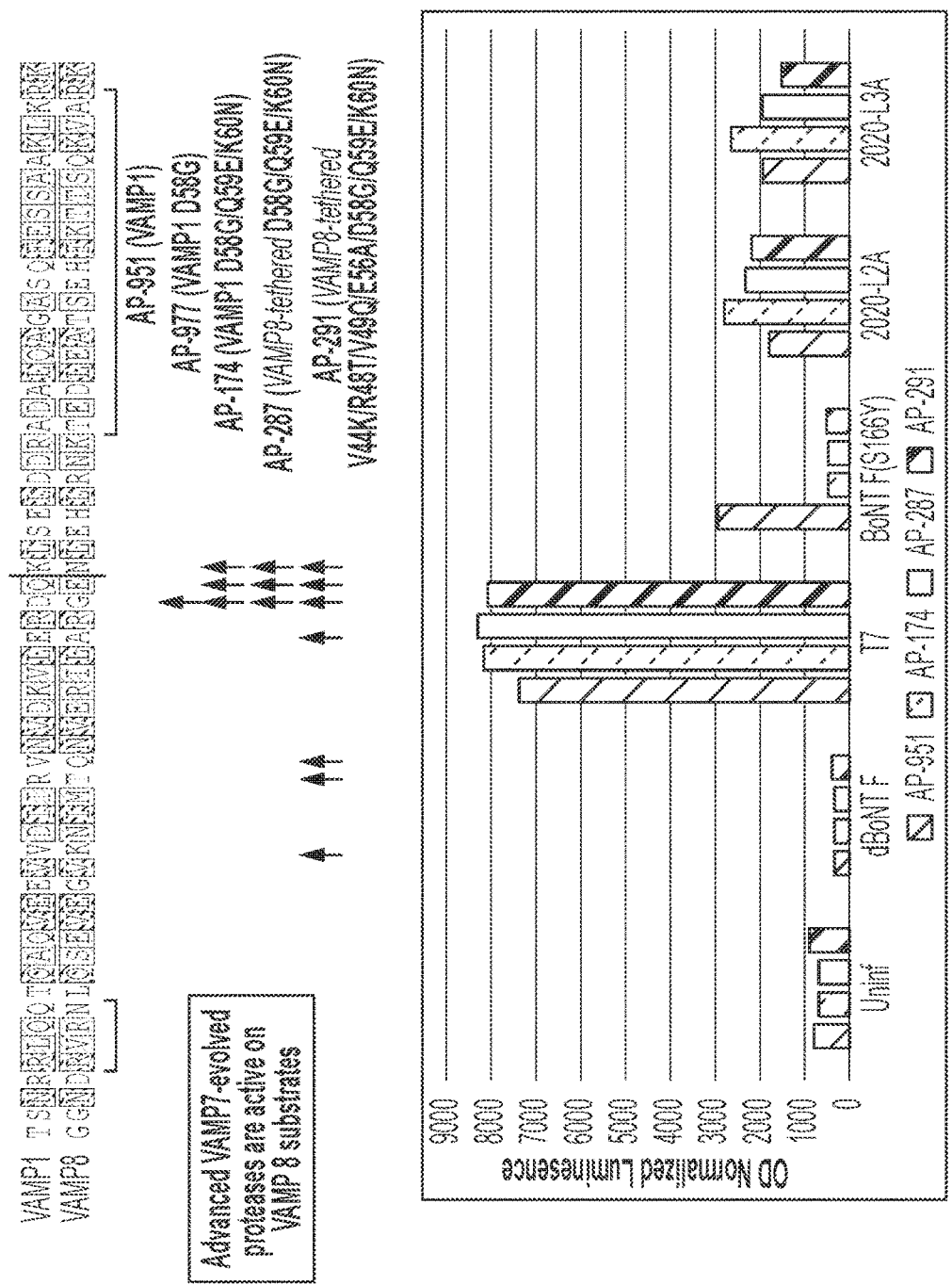
FIG. 27 shows an alignment of VAMP1 and VAMP8 amino acid sequences, along with several APs used to evolve VAMP8-cleaving BoNT F variants. Data indicate that VAMP8 APs have high background, but BoNT F variants that cleave VAMP8 were identified. From top to bottom, sequences correspond to SEQ ID NOs: 355-356.

FIG. 27 shows an alignment of VAMP1 and VAMP8 amino acid sequences, along with several APs used to evolve VAMP8-cleaving BoNT F variants. Data indicate that VAMP8 APs have high background but BoNT F variants that cleave VAMP8 were identified (FIG. 27).

Example 4

Evolution of BoNT E by PACE

Figure 28:
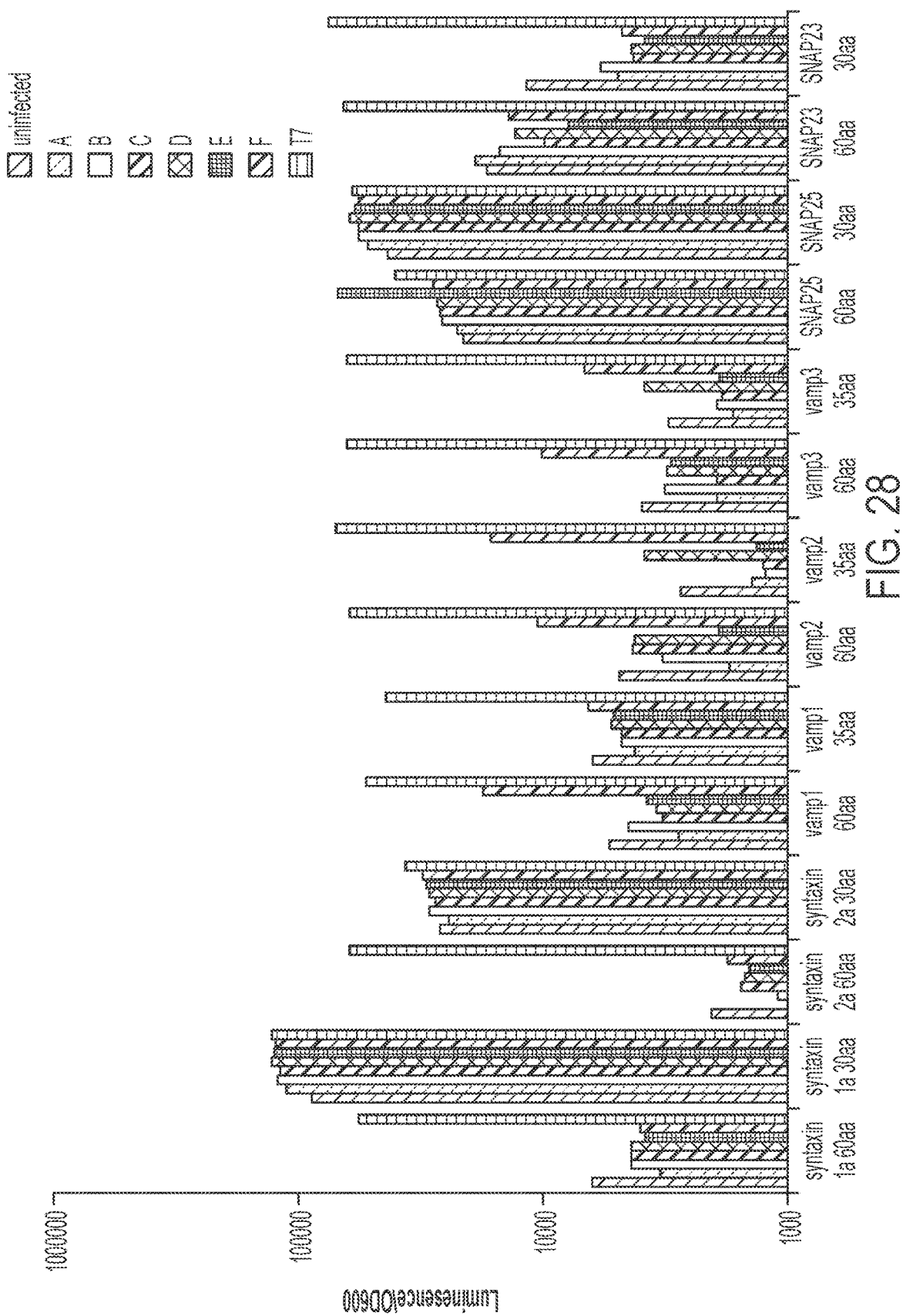
FIG. 28 shows data indicating that wild-type BoNT E cleaves SNAP25 protein.
Figure 29:
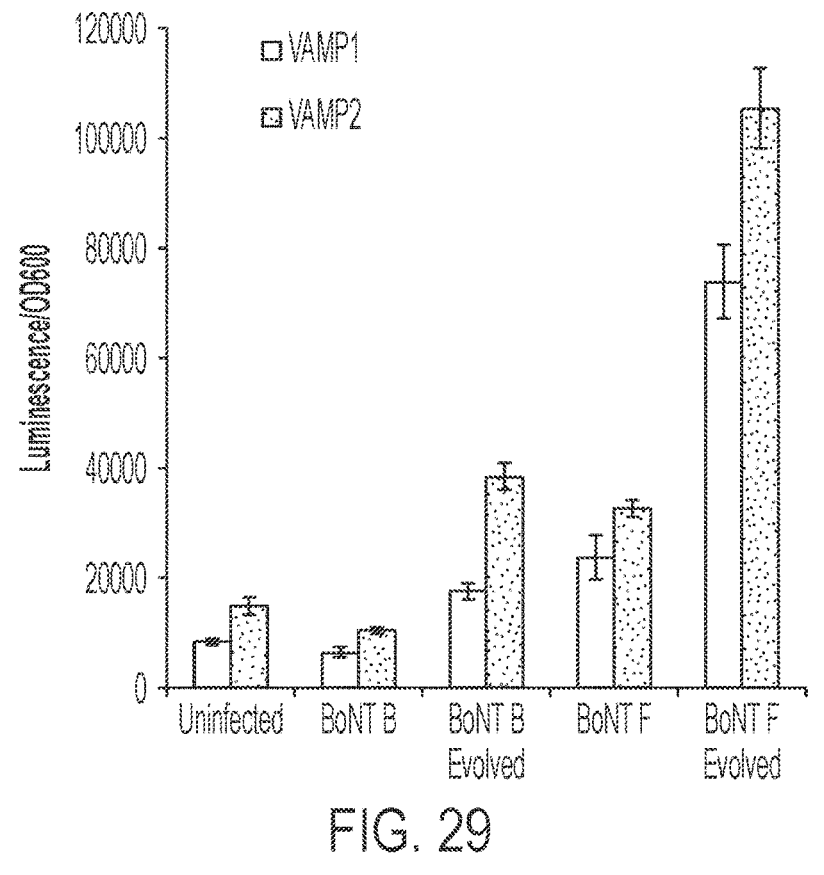

Wild-type BoNT E cleaves SNAP25 protein (FIG. 28). This example describes evolution of BoNT E to cleave the non-native substrates, such as SNAP23 and PTEN proteins. First, cleavage of SNAP25 residues 166-186 was examined by a protease-dependent luminescence assay. Data indicate that mutation of the residue at position 179 (e.g., D179K) of SNAP25 abolished protease activity by BoNT E (FIG. 29).

Figure 30:
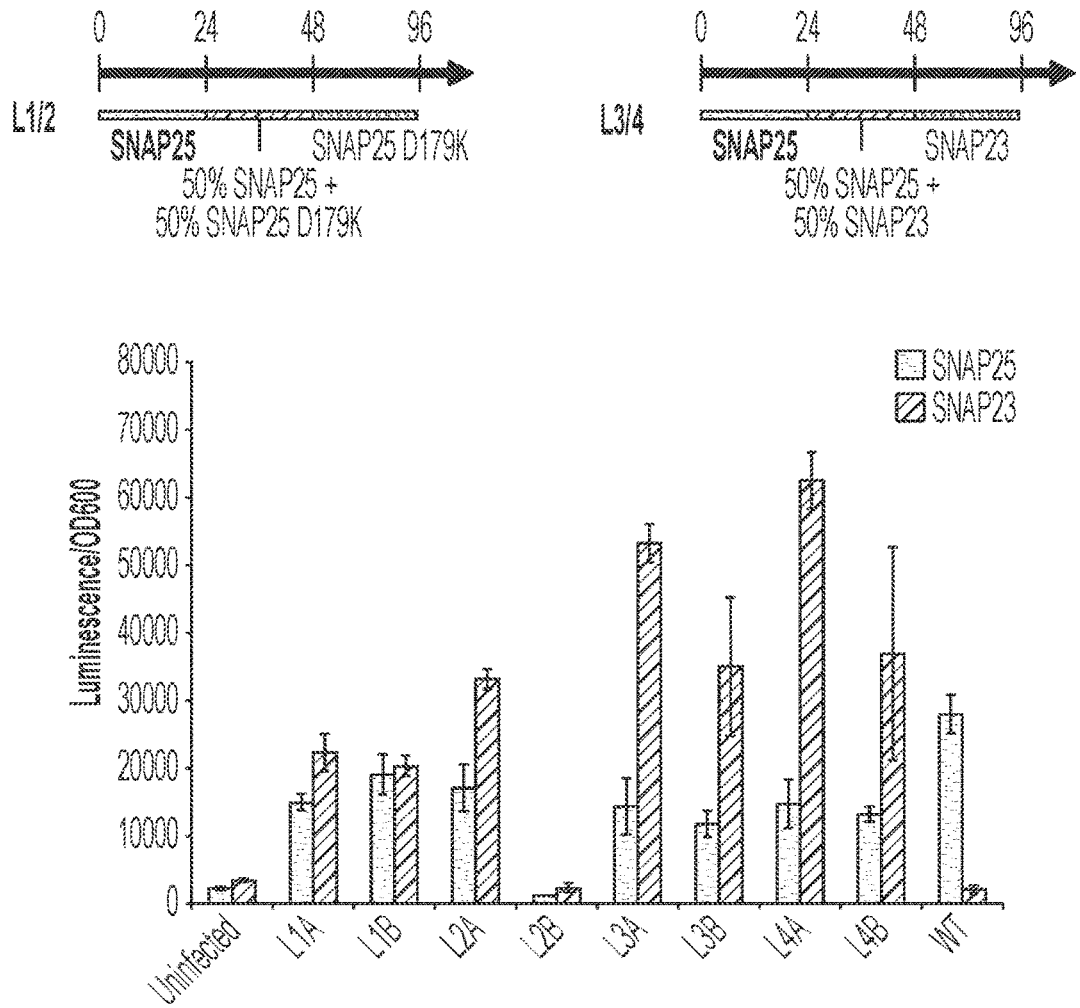
FIG. 30 shows PACE strategies used to generate SNAP23 cleaving BoNT E variants as well as data indicating that several BoNT E variants produced by PACE can cleave SNAP23.

Two different PACE experiments were performed. In the first experiment (Lagoons 1 and 2), BoNT E protein variants were evolved in the presence of a two-substrate gradient (SNAP25 and SNAP25 D179K). In the second experiment (Lagoons 3 and 4), BoNT E protein variants were evolved in the presence of a different two-substrate gradient (SNAP25 and SNAP23). Table 4 below shows mutations of variants produced in each experiment. Data indicate that several BoNT E variants that cleave SNAP 23 were evolved (FIG. 30)

TABLE 4

| Lagoon | Clone | Mut1 | Mut2 | Mut3 | Mut4 | Mut5 | Mut6 |
|---|---|---|---|---|---|---|---|
| L1 | A | I18V | | L89P | | | K225E |
| | B | I18V | | L89P | | | K225E |
| | C | I18V | | | E154G | I199T | K225E |
| | D | I18V | | L89P | | | K225E |
| | E | | | | E154G | | K225E |
| | F | I18V | | | E154G | | K225E |
| | G | | Q27H | | | | K225E |
| | H | | Q27H | | | | K225E |
| L2 | A | | E28K | | | | K225E |
| | B | | E28K | | | | K225E |
| | C | | E28K | | | | K225E |
| | D | | E28K | | | | K225E |
| | E | | E28K | | | | K225E |
| | F | | E28K | | | | K225E |
| L3 | A | I18V | | | E154G | R168K | K225E |
| | B | I18V | | | E154G | | K225E |
| | C | | | | E154G | | K225E |
| | D | I18V | | | E154G | R168K | K225E |
| | E | | | | E154G | S187F | K225E |
| | F | I18V | | | E154G | R168K | K225E |
| | H | I18V | | | E154G | R168K | K225E |
| L4 | A | | E28K | Q141K | E154G | | K225E |
| | B | | E28K | Q141K | E154G | | K225E |
| | C | | E28K | Q141K | E154G | | K225E |
| | E | | E28K | Q141K | E154G | | K225E |
| | F | | E28K | Q141K | E154G | | K225E |
| | G | | E28K | Q141K | E154G | | K225E |
| | H | | E28K | Q141K | E154G | | K225E |

| Lagoon | Clone | MutA | MutB | MutC | MutD | MutE |
|---|---|---|---|---|---|---|
| L1 | A | | | V265G | | |
| | B | | | | | L404* |
| | C | | N258S | | | |
| | D | | | | | |
| | E | | | | | |
| | F | | | | | |
| | G | | | | | L404* |
| | H | | | | | L404* |
| L2 | A | C231R | | | | L404* |
| | B | C231R | | | | L404* |
| | C | C231R | | | | L404* |
| | D | C231R | | | | |
| | E | C231R | | N261D | | |
| | F | C231R | | | | L404* |
| L3 | A | | | | | P398L |
| | B | | | | | |
| | C | | | | D270N | |
| | D | | | | | P398L |
| | E | | | | | |
| | F | | | | | P398L |
| | H | | | | | P398L |
| L4 | A | C231R | I233T | | | I396S |
| | B | C231R | I233T | | | I396S |
| | C | C231R | I233T | | | I396S |
| | E | C231R | I233T | | | I396S |
| | F | C231R | I233T | | | I396S |
| | G | C231R | I233T | | | I396S |
| | H | C231R | I233T | | | I396S |

Figure 31:
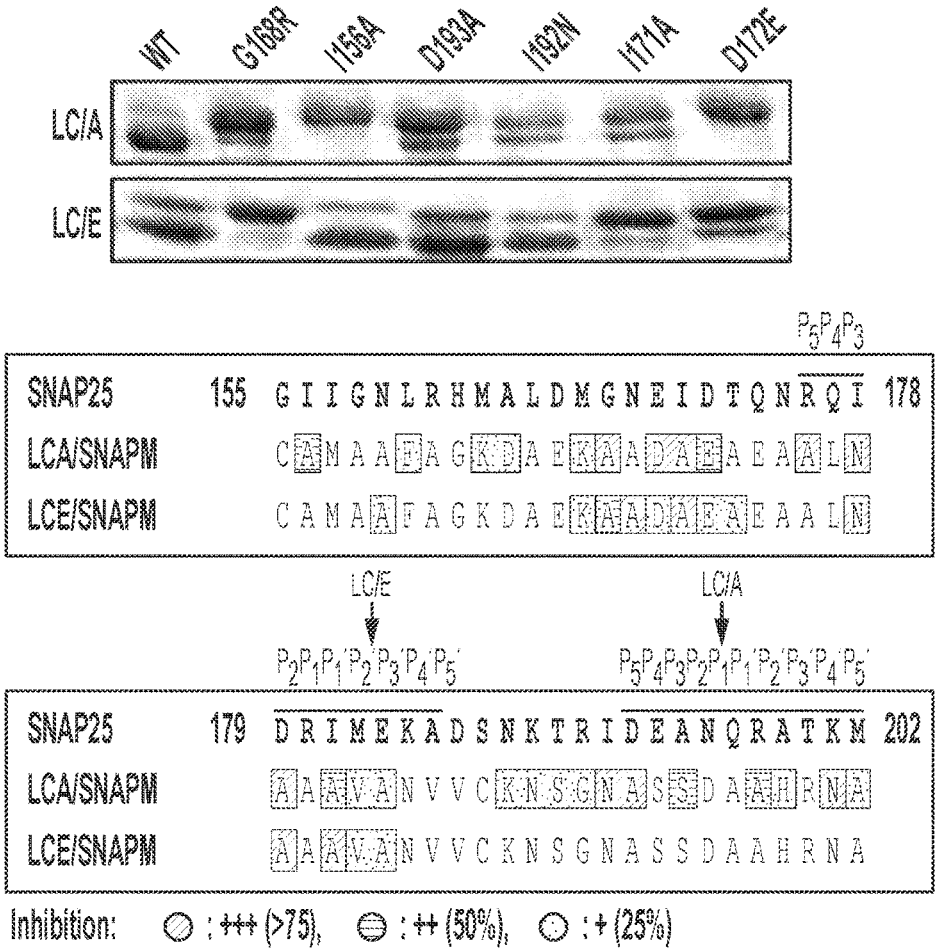
FIG. 31 shows a portion of the SNAP25 amino acid sequence and the peptide bonds at which wild-type BoNT A and BoNT E proteases that cleave SNAP25, but not SNAP23. From top to bottom, sequences correspond to SEQ ID NOs: 357-362.

Next, whether BoNT E variants that cleave a therapeutic target could be evolved was investigated. FIG. 31 shows a portion of the SNAP25 amino acid sequence and the peptide bonds at which wild-type BoNT A and BoNT E proteases that cleave SNAP25, but not SNAP23. FIG. 32 shows a stepping stone schematic for PACE of BoNT E to cleave the therapeutic target phosphatase and tensin homolog (PTEN). Tables 5 and 6 below shows mutations of BoNT E variants produced in each experiment.

TABLE 5

| | | | | | | | | |
|---|---|---|---|---|---|---|---|---|
| L1A | | K22R | | E28K | | | E154G | |
| L1B | | | | | | | E154G | T160A |
| L1C | | | | | | | E154G | T160A |
| L1D | | K22R | | E28K | | | E154G | |
| L1E | | K22R | | E28K | | | E154G | |
| L1F | | K22R | | E28K | | | E154G | |
| L1G | | | | | | | E154G | T160A |
| L1H | | | | | | | E154G | |
| L2A | | | | E28K | | | E159A | T160A | N161H |
| L2B | | | | E28K | | D128G | E159A | T160A | N161H |
| L2C | I21M | | | E28K | | | E159A | T160A | N161H |
| L2D | I21M | | | E28K | | | E159A | T160A | N161H |
| L2E | | | | E28K | | | E159A | T160A | N161H |
| L2F | | | Q27H | | S99A G101S | | E159L | | N161Y |
| L2H | | | | E28K | | T119K | E159A | T160A | N161H |
| L3A | | | | | | | E159C | | N161W |
| L3B | | | | | | | E159C | T160S | N161W |
| L3C | | | | | | | E159C | T160S | N161W |
| L3D | | | | | | | E159C | | N161W |
| L3E | | | | | | | E159C | T160S | N161W |
| L3F | | | | | | | E159C | T160S | N161W |
| L3G | | | | | | | E159C | | N161W |
| L3H | | | | | | | E159C | T160S | N161W |
| L4A | | | | E28K | | | | | |
| L4B | | | | E28K | | | | | |
| L4C | | | | E28K | | | | | |
| L4D | | | | E28K | | | | | |
| L4E | | | | E28K | | | | | |
| L4F | | | | E28K | | | | | |
| L4G | S6G | | | E28K | | | | | |
| L4H | | | | E28K | | | | | |

| | | | | | | |
|---|---|---|---|---|---|---|
| L1A | | S163R | | | K225H | | |
| L1B | | | | | K225H | C231R | |
| L1C | | | | | K225H | C231R | |
| L1D | | S163R | | | K225H | | |
| L1E | | S163R | | | K225H | | |
| L1F | | S163R | | | K225H | | |
| L1G | | | | | K225H | C231R | |
| L1H | S162A | | M172R | | K225H | | |
| L2A | | | | S174A | | | |
| L2B | | | | S174A | | | |
| L2C | | | | S174A | | | |
| L2D | | | | S174A | | | |
| L2E | | S163R | | S174A | | | K245R |
| L2F | S162Q | | | | | I232T | |
| L2H | | | | S174A | | | |
| L3A | | | | | K225L | C231R | |
| L3B | | | | I199M | K225L | C231R | |
| L3C | | | | | K225L | C231R | |
| L3D | | | | A224S | K225L | C231R | K245R |
| L3E | | | | I199M | K225L | C231R | |
| L3F | | | | | K225L | C231R | |
| L3G | | | | | K225L | C231R | |
| L3H | | | | I199M | K225L | C231R | |
| L4A | | | | | K225L | I232T | |
| L4B | | | | | K225L | I232T | |
| L4C | | | | | K225L | I232T | |
| L4D | | | | | K225L | I232T | |
| L4E | | | | | K225L | I232T | |
| L4F | | | | | K225L | I232T | |
| L4G | | | | | K225L | I232T | |
| L4H | | | | | K225L | I232T | |

| | | | | | |
|---|---|---|---|---|---|
| L1A | | | I352A | Y357C | |
| L1B | I263V | | | Y357C | |
| L1C | I263V | | | Y357C | |
| L1D | | | I352A | Y357C | |
| L1E | | | I352A | Y357C | |
| L1F | | | I352A | Y357W | |
| L1G | I263V | | | Y357C | I399S |
| L1H | | | | | |
| L2A | | Q354R | Y355H | | L404* |

TABLE 5-continued

| | | | | | | | | |
|---|---|---|---|---|---|---|---|---|
| L2B | | | | Q354R | Y355H | | L404* | |
| L2C | | | | Q354R | Y355H | | L404* | |
| L2D | | | | Q354R | Y355H | | L404* | |
| L2E | | V265G | | Q354R | Y355H | | | |
| L2F | | | | Q354R | Y355H | | | |
| L2H | | | | Q354R | Y355H | | L404* | |
| L3A | | | | Q354R | Y355H | | | |
| L3B | | V265G | | Q354R | | Y357C | | |
| L3C | | | | | | Y357C | | |
| L3D | | | | Q354R | Y355H | | | |
| L3E | | V265G | A313S | Q354R | | Y357C | | |
| L3F | | | | | | Y357C | L404* | |
| L3G | I247V | V265G | I352V | | | Y357C | | |
| L3H | | V265G | | | | Y357C | | |
| L4A | | | | Q354R | Y355H | | | |
| L4B | | | | Q354R | Y355H | | | |
| L4C | | | | Q354R | Y355H | | | |
| L4D | | | | Q354R | Y355H | | | |
| L4E | | | | Q354R | Y355H | | | |
| L4F | | | | Q354R | Y355H | | | |
| L4G | | | | Q354R | Y355H | | | |
| L4H | | | | Q354R | Y355H | | | |

TABLE 6

| | | | | | | | | | |
|---|---|---|---|---|---|---|---|---|---|
| L2A | Q27H | I35L | | S99A | G101S | | E159L | N161Y | S162Q | M172R |
| L2B | Q27H | | | S99A | G101S | | E159L | N161Y | S162Q | M172K |
| L2C | Q27H | | | S99A | G101S | | E159L | N161Y | S162Q | M172K |
| L2D | Q27H | | | S99A | G101S | V132G | E159L | N161Y | S162Q | M172K |
| L2F | Q27H | | | S99A | G101S | | E159L | N161Y | S162Q | M172K |
| L2G | Q27H | | | S99A | G101S | | E159L | N161Y | S162Q | M172K |
| L2H | Q27H | | D53Y | S99A | G101S | | E159L | N161Y | S162Q | |

| | | | | | | | | |
|---|---|---|---|---|---|---|---|---|
| L2A | I199V | I232T | N243S | T273I | | Q354R | Y355H | L404* |
| L2B | | I232T | | | I302M | Q354R | Y355H | |
| L2C | | I232T | | | | Q354R | Y355H | |
| L2D | | I232T | | | | Q354R | Y355H | |
| L2F | | I232T | | | | Q354R | Y355H | |
| L2G | | I232T | | | | Q354R | Y355H | |
| L2H | | I232T | | | | Q354R | Y355H | |

Figure 33:
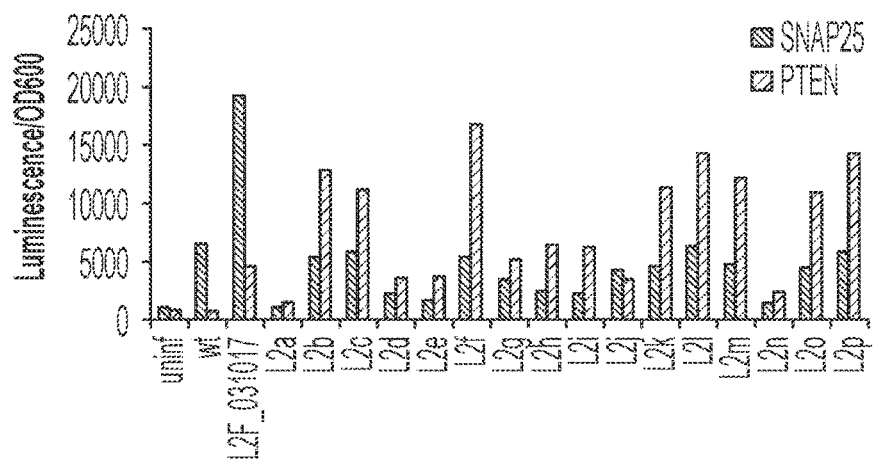
FIG. 33 shows luminescence assay data for several BoNT E variants that cleave PTEN.

Simultaneous positive (proB stringency) and negative selection (SNAP25, mixing from proA to proB) of BoNT E variants that cleave PTEN was performed. Evolution of several BoNT E variants that cleave PTEN was observed (FIG. 33). Table 7 below shows mutations of BoNT E variants produced in this experiment.

TABLE 7

| | | | | | | | | | | | |
|---|---|---|---|---|---|---|---|---|---|---|---|
| L2 | A | | Q27H | F29L | | | S99A | G101S | N118D | G127S | E159L | N161Y | S162Q |
| L2 | B | | Q27H | | | | S99A | G101S | N118D | | E159L | N161Y | S162Q |
| L2 | C | | Q27H | | | | S99A | G101S | N118D | | E159L | N161Y | S162Q |
| L2 | D | C26Y | Q27H | | | | S99A | G101S | N118D | | E159L | N161Y | S162Q |
| L2 | E | | Q27H | | Y68H | | S99A | G101S | N118D | | E159L | N161Y | S162Q |
| L2 | F | | Q27H | | | | S99T | G101S | N118D | | E159L | N161Y | S162Q |
| L2 | G | C26Y | Q27H | | | | S99A | G101S | N118D | | E159L | N161Y | S162Q |
| L2 | H | | Q27H | | | | S99A | G101S | N118D | | E159L | N161Y | S162Q |
| L2 | I | | Q27H | | | | S99A | G101S | N118D | | E159L | N161Y | S162Q |
| L2 | J | | Q27H | | | | S99A | G101S | N118D | | E159L | N161Y | S162Q |
| L2 | K | | Q27H | | | | S99A | G101S | N118D | | E159L | N161Y | S162Q |
| L2 | L | | Q27H | | | | S99A | G101S | N118D | | E159L | N161Y | S162Q |
| L2 | M | | Q27H | | | | S99A | G101S | N118D | | E159L | N161Y | S162Q |
| L2 | N | | Q27H | | | | S99A | G101S | N118D | | E159L | N161Y | S162Q |
| L2 | O | | Q27H | | | | S99A | G101S | N118D | | E159L | N161Y | S162Q |
| L2 | P | | Q27H | | | | S99A | G101S | N118D | | E159L | N161Y | S162Q |

| | | | | | | | | | |
|---|---|---|---|---|---|---|---|---|---|
| L2 | A | S163R | M172K | I232T | | | Q354R | Y357P | | |
| L2 | B | S163R | M172K | I232T | | | Q354R | Y357P | | |
| L2 | C | S163R | M172K | I232T | | | Q354R | Y357P | | |
| L2 | D | S163R | M172K | I232T | N238S | | Q354R | Y357H | | |
| L2 | E | S163R | M172K | I232T | | | Q354R | Y357P | | I409T |
| L2 | F | S163R | M172K | I232T | | | Q354R | Y357P | L404* | |
| L2 | G | S163R | M172K | I232T | | | Q354R | Y357H | | |
| L2 | H | S163R | M172K | I232T | | | Q354R | Y357P | | |
| L2 | I | S163R | M172K | I232T | | Q295R | Q354R | Y357P | | |

TABLE 7-continued

| | | | | | | |
|---|---|---|---|---|---|---|
| L2 | J | S163R | M172K | I232T | Q354R | Y357H |
| L2 | K | S163R | M172K | I232T | Q354R | Y357P |
| L2 | L | S163R | M172K | I232T | Q354R | Y357P |
| L2 | M | S163R | M172K | I232T | Q354R | Y357P |
| L2 | N | S163R | M172K | I232T | Q354R | Y357P |
| L2 | O | S163R | M172K | I232T | Q354R | Y357P |
| L2 | P | S163R | M172K | I232T | Q354R | Y357P |

Figure 34:
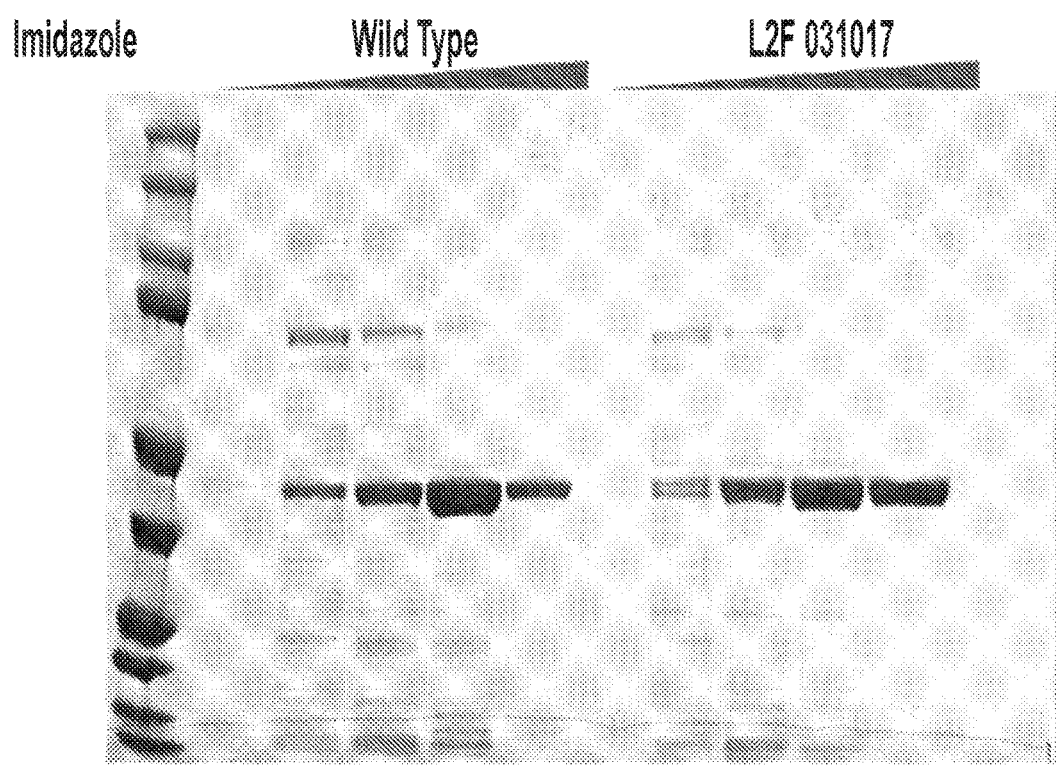
FIG. 34 shows an evolved BoNT E variant (L2F 031017) was expressed and purified by His-tag affinity chromatography and eluted with increasing concentrations of imidazole.
Figure 35:
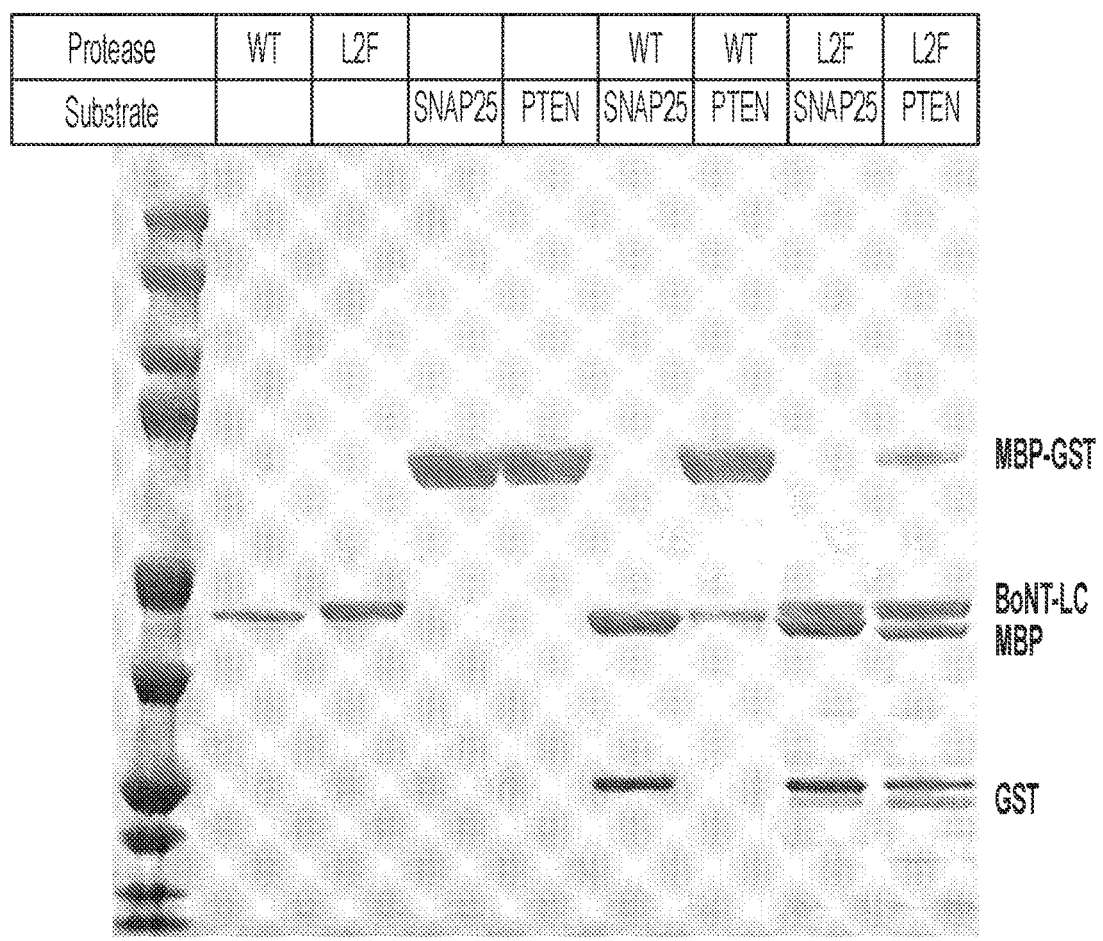
FIG. 35 shows data indicating that BoNT E L2F cleaves both SNAP25 and PTEN substrates.
Figure 36:
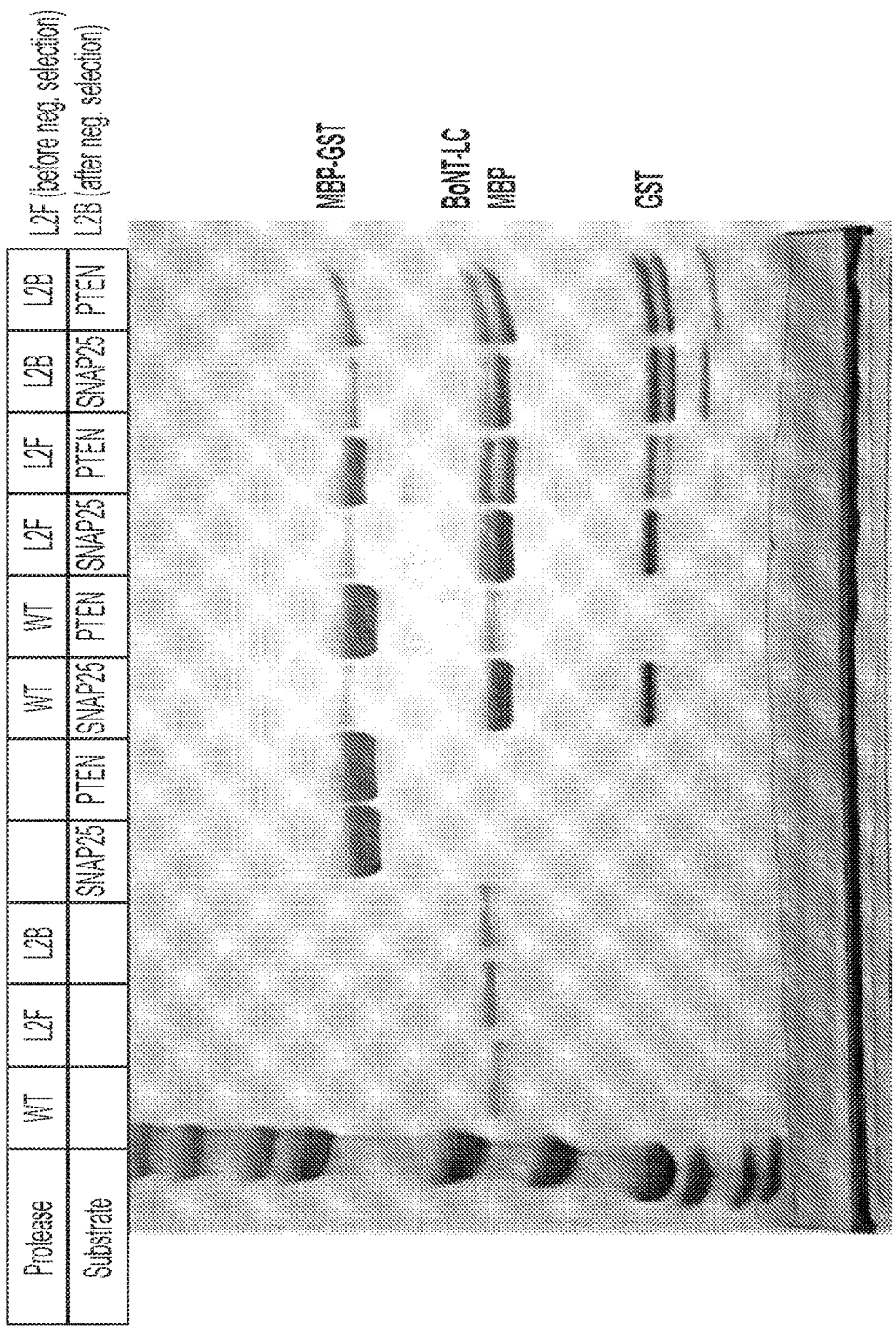
FIG. 36 shows data indicating that negative selection PACE results in improved PTEN substrate cleavage by BoNT E variants.
Figure 37:
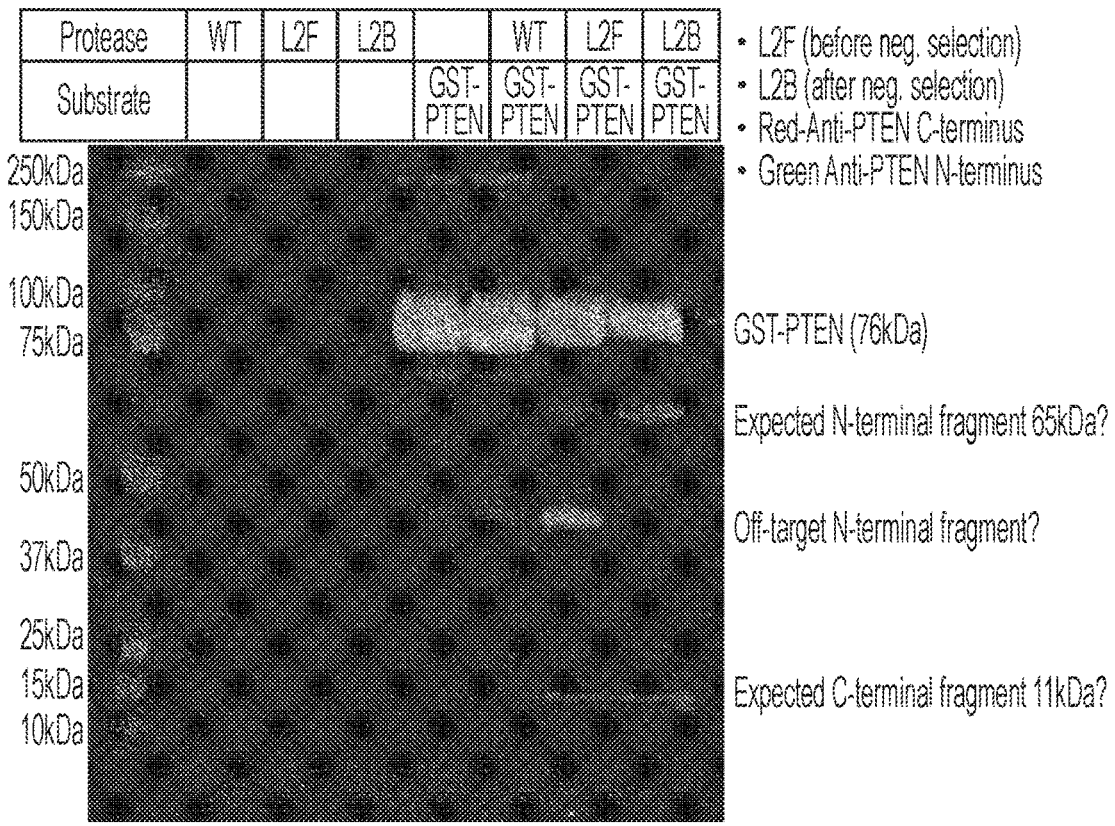
FIG. 37 shows data indicating BoNT E variant L2B after both positive and negative selection PACE cleaves full-length human PTEN protein at a single peptide bond yielding fragments of approximately the expected molecular weight.

An evolved BoNT E variant (L2F 031017) was expressed and purified by increasing concentrations of imidazole (FIG. 34). A proteolysis assay was performed, using SNAP25 and PTEN as substrates. Data indicate that BoNT E L2F cleaves both SNAP25 and PTEN (FIG. 35). PACE using negative selection results in improved PTEN cleavage, for example by L2B variant as shown in FIG. 36.

PACE Evolution Tables

TABLE 8

BoNT E PACE 1 Variants

| Variant | | | | | | | |
|---|---|---|---|---|---|---|---|
| 1 | Q27K | | | | | | |
| 2 | Q27K | | | | | | |
| 3 | | E28K | | | | | |
| 4 | | | | | | | |
| 5 | Q27K | | | | | | |
| 6 | | E28K | | | | | |
| 7 | | E28K | | | | | |
| 8 | | | | | | | |
| 9 | | | | | | E159A | N161H |
| 10 | Q27K | | | | | E159A | N161H |
| 11 | Q27K | | | | | | |
| 12 | | | | | | E159A | |
| 13 | | | | | | E159A | |
| 14 | | | | | | E159L | N161Y |
| 15 | | E28K | | | | E159S | N161H |
| 16 | | | | | | E159A | N161Y |
| 17 | Y20C | E28K | E78G | | D128A | A129Q | |
| 18 | | | | | D128G | A129G | |
| 19 | | | | | D128G | A129Q | |
| 20 | | | | | D128A | A129Q | |
| 21 | | | | | D128A | A129Q | |
| 22 | | | | | | | |
| 23 | | | | | | | |
| 24 | | | | | D128G | A129Q | |
| 25 | | | | | | | |
| 26 | | E28K | | | | | |
| 27 | | E28K | | | | | |
| 28 | | | | G101S | | | |
| 29 | | E28K | L98P | | | | |
| 30 | | | | | | | |
| 31 | | E28K | | | | | |
| 32 | | | | G101S | | | |

| | | | | | | | | |
|---|---|---|---|---|---|---|---|---|
| | K225L | | | | | | | |
| | K225H | I232S | | | | | | |
| | K225L | | I352T | | | | | |
| | K225L | | | | | | | |
| | K225H | | | | | | | |
| | K225H | I232T | | | | | | |
| | K225H | | | | | | | |
| | K225L | | | | | | | |
| | | I232S | | | | | | |
| | | I232S | | | | | | |
| | | I232T | | | | | | |
| | | I232T | V345I | | | | L404* | |
| | | | | I399S | | | | |
| | I227T | | | | | | | |
| | | | | | T400A | | | |
| I165V | | I232T | | | | | | |
| | | I232T | | | | | | |
| R168K | | | | | | | | |
| | | | F358L | | | | | |
| | I232S | | | | T400K | | | |
| R168K | I232T | | | | | | | |

Unique amino acid sequences of BoNT E PACE 1 variants are provided in SEQ ID NOs: 1-26.

TABLE 9

BoNT E PACE 2 Variants

| Variant | | | | | | | | | | | |
|---|---|---|---|---|---|---|---|---|---|---|---|
| 1 | | | | L98P | | | | | | | |
| 2 | | E28K | | | | | | | | | |
| 3 | Q27R | | | L98P | | | | | N197K | | I199M |
| 4 | | E28K | | | | | | | | | |
| 5 | | | | | | | Y171C | | | | A224S |
| 6 | K22S | E28K | | | | | | E184G | | | |
| 7 | | | | | | | | | | | |
| 8 | | | | | | | | | | | |
| 9 | | | | | | | | | | | |
| 10 | | | V47I | L98P | | | | | | | |
| 11 | | | | | | | | | | | |
| 12 | | | | | | | | | N197K | | |
| 13 | | E28K | | | E159S | N161H | M172S | | | | |
| 14 | | | | | E159S | N161W | | | | | |
| 15 | Q27R | | | L98P | E159W | N161W | | | | | |
| 16 | | | | | E159Q | N161Y | | | | | |
| 17 | | | | | E159A | N161W | M172V | | | | |
| 18 | Q27R | | | L98P | E159A | N161V | | | | | |
| 19 | | | | L98P | E159C | N161W | | | | | |
| 20 | | E28K | | | | | | | | | |
| 21 | | | | | | | | | | | |
| 22 | | E28K | | | | | | | | | |
| 23 | | | | | E159A | N161H | | | | | |
| 24 | | E28K | | | | | | | | S198G | |
| 25 | | | | | | | | | | | |
| 26 | | | | | E159A | N161H | | | | | |

(continued)

| Variant | | | | | | | | | | |
|---|---|---|---|---|---|---|---|---|---|---|
| 1 | K225H | | | | | | | | | |
| 2 | K225L | | | | | | | | | |
| 3 | K225H | | | | | | | | | |
| 4 | K225L | I227V | | | | I352T | | | | L404* |
| 5 | K225H | | | | | | | | | |
| 6 | K225H | | | | | | | Y357C | | |
| 7 | | | I232T | | | | | | | |
| 8 | | | I232T | | | Q354R | Y355H | | | |
| 9 | | | I232T | V265G | | | | | | |
| 10 | | | I232T | | | | | | S372G | |
| 11 | | | I232T | | | Q354R | Y355H | | | N379K |
| 12 | | | I232T | | S314A | Q354R | Y355H | | | |
| 13 | K225H | C231G | | | | | | | | |
| 14 | K225L | | | | | I352T | | | | I409L |
| 15 | K225H | | | | | | | | | |
| 16 | K225H | | | | | | | | | |
| 17 | K225L | C231R | | | | | | | | |
| 18 | K225H | | | | | | | | | |
| 19 | K225L | C231R | | | | | | | | |
| 20 | K225L | | I232T | | | | | | | |
| 21 | K225L | | I232T | | | | | | | |
| 22 | K225L | | I232T | | | | | | | |
| 23 | K225Y | | I232T | N242S | | | | | | |
| 24 | K225L | | I232T | | | | | | | |
| 25 | K225L | | I232T | | | | | | | |
| 26 | K225H | | | | | | | | | |

Unique amino acid sequences of BoNT E PACE 2 variants are provided in SEQ ID NOs: 27-49.

TABLE 10

BoNT E PACE 3 Variants

| Variant | | | | | | | |
|---|---|---|---|---|---|---|---|
| 1 | | E148G | | T160A | | Y171C | |
| 2 | | E148G | | | | | |
| 3 | | E148G | | | | | |
| 4 | | E148G | | | | | F186L |
| 5 | | E148G | | | | Y171C | |
| 6 | Q141R | | E159A | T160A | N161H | | S174A |
| 7 | | | E159A | T160A | N161H | | S174A |
| 8 | | | E159A | T160A | N161H | | S174A |
| 9 | | | E159A | T160A | N161H | | S174A |
| 10 | | | E159A | T160A | N161H | | S174A |
| 11 | | | E159C | T160S | N161W | | |

TABLE 10-continued

BoNT E PACE 3 Variants

| | | | | | | | | | |
|---|---|---|---|---|---|---|---|---|---|
| 12 | | | E159C | | N161W | M172R | | | |
| 13 | | | E159R | | N161Y | | | N197K | I199M |
| 14 | | | E159C | T160S | N161W | | | | |
| 15 | | | E159C | | N161W | | | | |
| 16 | | | E159C | T160S | N161W | | | | |
| 17 | | | E159S | | N161W | | | N197K | I199M |
| 18 | | | | | | | | | |
| 19 | | | | | | | | | |
| 20 | | N138D | | | | | | | |
| 21 | | | | | | | | | |
| 22 | | | | | | | | | |
| 23 | S137R | | | | | | | | |

| | | | | | | | | | | |
|---|---|---|---|---|---|---|---|---|---|---|
| K225H | C231Y | | | | | | | Y357C | | |
| K225H | | | | | | | | Y357H | | |
| K225H | | | | | | | | Y357C | | |
| K225H | | | | | | | | Y357C | | |
| K225H | | | | | | | | | | |
| | | I232T | | | | Q354R | Y355H | | | |
| | | I232T | | | | Q354R | Y355H | | | L404* |
| | | I232T | | | | Q354R | Y355H | | | |
| | | I232T | | | | Q354R | Y355H | | | |
| | | I232T | | D312N | | Q354R | Y355H | | A389T | |
| K225L | C231R | | | | | | | Y357S | | |
| K225L | C231R | | | | | | | Y357C | | |
| K225H | | | K311E | | | | | | | |
| K225L | C231R | | | | | | | Y357C | | |
| K225L | C231R | | | | | | | Y357C | | |
| K225L | C231R | | | | | | | | | |
| K225H | | | | | | | | | | |
| K225L | | I232T | | | | | | | | |
| K225L | | I232T | A266T | | | | | | | |
| K225L | | I232T | | | K329N | | | | | |
| K225L | | I232T | | | | | | | | |
| K225L | | I232T | | | | | | | | |
| K225L | | I232T | | | | | | | | |

Unique amino acid sequences of BoNT E PACE 3 variants are provided in SEQ ID NOs: 50-68.

TABLE 11

BoNT E PACE 4 Variants

| Variant | | | | | | | | |
|---|---|---|---|---|---|---|---|---|
| 1 | | | K22R | | E28K | | | |
| 2 | | | | | | | | |
| 3 | | | | | | | | |
| 4 | | | K22R | | E28K | | | |
| 5 | | | K22R | | E28K | | | |
| 6 | | | K22R | | E28K | | | |
| 7 | | | | | | | | |
| 8 | | | | | | | | |
| 9 | | | | | E28K | | | |
| 10 | | | | | E28K | | | D128G |
| 11 | I21M | | | | E28K | | | |
| 12 | I21M | | | | E28K | | | |
| 13 | | | | | E28K | | | |
| 14 | | | | Q27H | | S99A | G101S | |
| 15 | | | | | E28K | | T119K | |
| 16 | | | | | | | | |
| 17 | | | | | | | | |
| 18 | | | | | | | | |
| 19 | | | | | | | | |
| 20 | | | | | | | | |
| 21 | | | | | | | | |
| 22 | | | | | | | | |
| 23 | | | | | | | | |
| 24 | | | | | E28K | | | |
| 25 | | | | | E28K | | | |
| 26 | | | | | E28K | | | |
| 27 | | | | | E28K | | | |

TABLE 11-continued

BoNT E PACE 4 Variants

| | | | | | | | | |
|---|---|---|---|---|---|---|---|---|
| 28 | | | | | E28K | | | |
| 29 | | | | | E28K | | | |
| 30 | S6G | | | | E28K | | | |
| 31 | | | | | E28K | | | |

Variant

| | | | | | | | | |
|---|---|---|---|---|---|---|---|---|
| 1 | E154G | | | | | S163R | | |
| 2 | E154G | | T160A | | | | | |
| 3 | E154G | | T160A | | | | | |
| 4 | E154G | | | | | S163R | | |
| 5 | E154G | | | | | S163R | | |
| 6 | E154G | | | | | S163R | | |
| 7 | E154G | | T160A | | | | | |
| 8 | E154G | | | | S162A | | M172R | |
| 9 | | E159A | T160A | N161H | | | | S174A |
| 10 | | E159A | T160A | N161H | | | | S174A |
| 11 | | E159A | T160A | N161H | | | | S174A |
| 12 | | E159A | T160A | N161H | | | | S174A |
| 13 | | E159A | T160A | N161H | | S163R | | S174A |
| 14 | | E159L | | N161Y | S162Q | | | |
| 15 | | E159A | T160A | N161H | | | | S174A |
| 16 | | E159C | | N161W | | | | |
| 17 | | E159C | T160S | N161W | | | | |
| 18 | | E159C | T160S | N161W | | | | |
| 19 | | E159C | | N161W | | | | |
| 20 | | E159C | T160S | N161W | | | | |
| 21 | | E159C | T160S | N161W | | | | |
| 22 | | E159C | | N161W | | | | |
| 23 | | E159C | T160S | N161W | | | | |
| 24 | | | | | | | | |
| 25 | | | | | | | | |
| 26 | | | | | | | | |
| 27 | | | | | | | | |
| 28 | | | | | | | | |
| 29 | | | | | | | | |
| 30 | | | | | | | | |
| 31 | | | | | | | | |

| | | | | | | | | | |
|---|---|---|---|---|---|---|---|---|---|
| | K225H | | | | | I352A | | Y357C | |
| | K225H | C231R | | | I263V | | | Y357C | |
| | K225H | C231R | | | I263V | | | Y357C | |
| | K225H | | | | | I352A | | Y357C | |
| | K225H | | | | | I352A | | Y357C | |
| | K225H | | | | | I352A | | Y357W | |
| | K225H | C231R | | | I263V | | | Y357C | I399S |
| | K225H | | | | | | | | |
| | | | | | | Q354R | Y355H | | L404* |
| | | | | | | Q354R | Y355H | | L404* |
| | | | | | | Q354R | Y355H | | L404* |
| | | | | | | Q354R | Y355H | | L404* |
| | | | K245R | | V265G | Q354R | Y355H | | |
| | | I232T | | | | Q354R | Y355H | | |
| | | | | | | Q354R | Y355H | | L404* |
| | K225L | C231R | | | | Q354R | Y355H | | |
| I199M | K225L | C231R | | | V265G | Q354R | | Y357C | |
| | K225L | C231R | | | | | | Y357C | |
| A224S | K225L | C231R | K245R | | | Q354R | Y355H | | |
| I199M | K225L | C231R | | | V265G A313S | Q354R | | Y357C | |
| | K225L | C231R | | | | | | Y357C | L404* |
| | K225L | C231R | | I247V | V265G | I352V | | Y357C | |
| I199M | K225L | C231R | | | V265G | | | Y357C | |
| | K225L | | I232T | | | Q354R | Y355H | | |
| | K225L | | I232T | | | Q354R | Y355H | | |
| | K225L | | I232T | | | Q354R | Y355H | | |
| | K225L | | I232T | | | Q354R | Y355H | | |
| | K225L | | I232T | | | Q354R | Y355H | | |
| | K225L | | I232T | | | Q354R | Y355H | | |
| | K225L | | I232T | | | Q354R | Y355H | | |
| | K225L | | I232T | | | Q354R | Y355H | | |

Unique amino acid sequences of BoNT E PACE 4 variants are provided in SEQ ID NOs: 69-89.

TABLE 12

BoNT E PACE 5 Variants

| Variant | | | | | | | | | | |
|---|---|---|---|---|---|---|---|---|---|---|
| 1 | Q27H | I35L | | S99A | G101S | | E159L | N161Y | S162Q | M172R |
| 2 | Q27H | | | S99A | G101S | | E159L | N161Y | S162Q | M172K |
| 3 | Q27H | | | S99A | G101S | | E159L | N161Y | S162Q | M172K |
| 4 | Q27H | | | S99A | G101S | V132G | E159L | N161Y | S162Q | M172K |
| 5 | Q27H | | | S99A | G101S | | E159L | N161Y | S162Q | M172K |
| 6 | Q27H | | | S99A | G101S | | E159L | N161Y | S162Q | M172K |
| 7 | Q27H | | D53Y | S99A | G101S | | E159L | N161Y | S162Q | |

| Variant | | | | | | | | |
|---|---|---|---|---|---|---|---|---|
| 1 | I199V | I232T | N243S | T273I | | Q354R | Y355H | L404* |
| 2 | | I232T | | | I302M | Q354R | Y355H | |
| 3 | | I232T | | | I302M | Q354R | Y355H | |
| 4 | | I232T | | | | Q354R | Y355H | |
| 5 | | I232T | | | | Q354R | Y355H | |
| 6 | | I232T | | | | Q354R | Y355H | |
| 7 | | I232T | | | | Q354R | Y355H | |

Unique amino acid sequences of BoNT E PACE 5 variants are provided in SEQ ID NOs: 90-93.

TABLE 13

BoNT E PACE 6 Variants

| Variant | | | | | | | | | | |
|---|---|---|---|---|---|---|---|---|---|---|
| 1 | | Q27H | F29L | | S99A | G101S | N118D | G127S | E159L | N161Y | S162Q |
| 2 | | Q27H | | | S99A | G101S | N118D | | E159L | N161Y | S162Q |
| 3 | | Q27H | | | S99A | G101S | N118D | | E159L | N161Y | S162Q |
| 4 | C26Y | Q27H | | Y68H | S99A | G101S | N118D | | E159L | N161Y | S162Q |
| 5 | | Q27H | | | S99A | G101S | N118D | | E159L | N161Y | S162Q |
| 6 | | Q27H | | | S99T | G101S | N118D | | E159L | N161Y | S162Q |
| 7 | C26Y | Q27H | | | S99A | G101S | N118D | | E159L | N161Y | S162Q |
| 8 | | Q27H | | | S99A | G101S | N118D | | E159L | N161Y | S162Q |
| 9 | | Q27H | | | S99A | G101S | N118D | | E159L | N161Y | S162Q |
| 10 | | Q27H | | | S99A | G101S | N118D | | E159L | N161Y | S162Q |
| 11 | | Q27H | | | S99A | G101S | N118D | | E159L | N161Y | S162Q |
| 12 | | Q27H | | | S99A | G101S | N118D | | E159L | N161Y | S162Q |
| 13 | | Q27H | | | S99A | G101S | N118D | | E159L | N161Y | S162Q |
| 14 | | Q27H | | | S99A | G101S | N118D | | E159L | N161Y | S162Q |
| 15 | | Q27H | | | S99A | G101S | N118D | | E159L | N161Y | S162Q |
| 16 | | Q27H | | | S99A | G101S | N118D | | E159L | N161Y | S162Q |

| Variant | | | | | | | | |
|---|---|---|---|---|---|---|---|---|
| 1 | S163R | M172K | I232T | | | Q354R | Y357P | |
| 2 | S163R | M172K | I232T | | | Q354R | Y357P | |
| 3 | S163R | M172K | I232T | | | Q354R | Y357P | |
| 4 | S163R | M172K | I232T | N238S | | Q354R | Y357H | |
| 5 | S163R | M172K | I232T | | | Q354R | Y357P | I409T |
| 6 | S163R | M172K | I232T | | | Q354R | Y357P | L404* |
| 7 | S163R | M172K | I232T | | | Q354R | Y357H | |
| 8 | S163R | M172K | I232T | | | Q354R | Y357P | |
| 9 | S163R | M172K | I232T | | Q295R | Q354R | Y357P | |
| 10 | S163R | M172K | I232T | | | Q354R | Y357H | |
| 11 | S163R | M172K | I232T | | | Q354R | Y357P | |
| 12 | S163R | M172K | I232T | | | Q354R | Y357P | |
| 13 | S163R | M172K | I232T | | | Q354R | Y357P | |
| 14 | S163R | M172K | I232T | | | Q354R | Y357P | |
| 15 | S163R | M172K | I232T | | | Q354R | Y357P | |
| 16 | S163R | M172K | I232T | | | Q354R | Y357P | |

Unique amino acid sequences of BoNT E PACE 6 variants are provided in SEQ ID NOs: 94-100.

TABLE 14

BoNT F PACE 1 (1131) Variants

| Variant | | | | | | | | | | |
|---|---|---|---|---|---|---|---|---|---|---|
| 1 | | | | | S166Y | | | R240L | | F360L |
| 2 | | | | | S166Y | | | R240L | | F360L |
| 3 | | | | | S166Y | | N184K | R240L | | F360L |
| 4 | | | | | S166Y | | N184K | R240L | | F360L |
| 5 | | | | | S166Y | | | R240L | | F360L |
| 6 | | | K146R | N165S | S166Y | | | R240L | | F360L |
| 7 | Y113D | | K146R | | S166Y | | | R240L | | F360L |
| 8 | | | | | S166Y | | | R240L | | F360L |
| 9 | | | | | S166Y | | | R240L | S350G | F360L |
| 10 | | | | | S166Y | | | R240L | S350G | F360L |
| 11 | | | | | S166Y | | | R240L | S350G | F360L |
| 12 | | | | | S166Y | | | R240L | S350G | F360L |
| 13 | | | | | S166Y | | | R240L | S350G | F360L |
| 14 | | | | | S166Y | | N184S | R240L | S350G | F360L |
| 15 | | | | | S166Y | | | R240L | S350G | F360L |
| 16 | | | | | S166Y | D175A | N184K | R240L | | F360L |
| 17 | | | | | S166Y | | N184K | R240L | | F360L |
| 18 | | | | | S166Y | | N184K D185A | R240L | | F360L |
| 19 | A82V | | | | S166Y | | N184K | R240L | | F360L |
| 20 | A82V | | | | S166Y | | N184K | R240L | | F360L |
| 21 | | | | | S166Y | | N184K | R240L | | F360L |
| 22 | | | | | S166Y | | N184K | R240L | | F360L |
| 23 | | | | | S166Y | | N184K | R240L | | F360L |
| 24 | | | | | S166Y | | N184K | R240L | | F360L |

| Variant | | | | | | | | | |
|---|---|---|---|---|---|---|---|---|---|
| 1 | Y372H | | N396H | P410L | | | | | |
| 2 | Y372H | | | P410L | K411N | | | | |
| 3 | Y372H | | | P410L | | | | | |
| 4 | Y372H | | | P410L | | | | | |
| 5 | Y372H | | | P410L | | | | | |
| 6 | Y372H | | N396H | P410L | | | | | |
| 7 | Y372H | | | P410L | | | | | |
| 8 | Y372H | | N396H | P410L | | | | E423K | |
| 9 | Y372H | N379D | | P410L | | | | | |
| 10 | Y372H | N379D | N396H | P410L | G420A | L421W | V422L | E423R | I425S V426* |
| 11 | Y372H | | | P410L | G420A | L421W | V422L | E423R | I425S V426* |
| 12 | Y372H | | | P410L | G420A | L421W | V422L | E423R | I425S V426* |
| 13 | Y372H | | | P410L | G420A | L421W | V422L | E423R | I425S V426* |
| 14 | Y372H | | | P410L | G420A | L421W | V422L | E423R | I425S V426* |
| 15 | Y372H | | N396H | P410L | G420A | L421W | V422L | E423R | I425S V426* |
| 16 | Y372H | | | P410L | | | | | |
| 17 | Y372H | | N396H | P410L | | | | E423K | |
| 18 | Y372H | | N396H | P410L | | | | E423K | |
| 19 | Y372H | | N396H | P410L | G420V | | | E423K | |
| 20 | Y372H | | N396H | P410L | | | | E423K | |
| 21 | Y372H | | N396H | P410L | | | | E423K | |
| 22 | Y372H | | N396H | P410L | | | | E423K | |
| 23 | Y372H | | N396H | P410L | | | | E423K | |
| 24 | Y372H | | N396H | P410L | | | | E423K | |

Unique amino acid sequences of BoNT F PACE 1 variants are provided in SEQ ID NOs: 101-116.

TABLE 15

BoNT F PACE 2 (1207) Variants

| Variant | | | | | | | | | |
|---|---|---|---|---|---|---|---|---|---|
| 1 | | | | V155I | | | S166Y | N184K | R240L |
| 2 | | V106A | | | | E164G | S166Y | N184K | R240L |
| 3 | R41H | D60E | | | | | S166Y | N184K | R240L |
| 4 | | | | | | | S166Y | N184K | R240L |
| 5 | | | | V155I | | | S166Y | N184K | R240L |
| 6 | | V106A | | | | E164G | S166Y | N184K | R240L |
| 7 | | | | V155I | | | S166Y | N184K | R240L |
| 8 | | | Y113H | | D161N | E164G | S166Y | N184K | R240L |

| Variant | | | | | | |
|---|---|---|---|---|---|---|
| 1 | F360L | Y372H | N396H | P410L | K411E | E423K |
| 2 | F360L | Y372H | N396H | P410L | | E423K |

TABLE 15-continued

BoNT F PACE 2 (1207) Variants

| | | | | | | | | |
|---|---|---|---|---|---|---|---|---|
| 3 | N339T | F360L | Y372H | | N396H | P410L | | E423K |
| 4 | | F360L | Y372H | I385V | N396H | P410L | | E423K |
| 5 | | F360L | Y372H | | N396H | P410L | K411E | E423K |
| 6 | | F360L | Y372H | | N396H | P410L | | E423K |
| 7 | | F360L | Y372H | | N396H | P410L | K411E | E423K |
| 8 | | F360L | Y372H | | N396H | P410L | | E423K |

Unique amino acid sequences of BoNT F PACE 2 variants are provided in SEQ ID NOs: 117-121.

TABLE 16

BoNT F PACE 3 (1216) Variants

| Variant | | | | | | | | | | | | | | |
|---|---|---|---|---|---|---|---|---|---|---|---|---|---|---|
| 1 | | | | | | | | | S166Y | | D175G | N184K | | |
| 2 | | | | | | | | | S166Y | | | N184K | | |
| 3 | | | | | | | | N165S | S166Y | | | N184K | | |
| 4 | | | | | | | | | S166Y | | | N184K | | |
| 5 | | | | | | | | N165S | S166Y | | | N184K | | |
| 6 | | | | | | | | N165S | S166Y | | | N184K | | |
| 7 | S30N | | | E66D | | | Y113D | | S166Y | | | N184K | | T214A |
| 8 | | | | E66D | | | | | S166Y | | D175G | N184K | | |
| 9 | | | | | | V106A | | | S166Y | | | | | |
| 10 | | | | | | V106A | | | S166Y | | | N184K | | |
| 11 | | | | | | V106A | | | S166Y | | | N184K | | |
| 12 | | | | | | V106A | | | S166Y | S167I | | N184K | S189I | |
| 13 | | | | | | V106A | | | S166Y | S167I | | | | |
| 14 | | | | | | V106A | | | S166Y | S167I | | | | |
| 15 | | | | | | V106A | | | S166Y | S167I | | | | |
| 16 | | | | | | V106A | | | S166Y | | | N184K | | |
| 17 | | | | | | | | | S166Y | | | N184K | | |
| 18 | | | | | | | | | S166Y | | | N184K | D185A | |
| 19 | | | | | A82V | | | | S166Y | | | N184K | | |
| 20 | | | | | | | | | S166Y | | | N184K | | |
| 21 | | | | | | | | | S166Y | | | N184K | | |
| 22 | | | | | | | | | S166Y | | | N184K | | |
| 23 | | R41H | D60E | | | | | | S166Y | | | N184K | | |
| 24 | I39V | | | | A82V | | | | S166Y | | | N184K | | |

| | | | | | | | |
|---|---|---|---|---|---|---|---|
| R240L | | | | | | F360L | Y372H |
| R240L | | | | | | F360L | Y372H |
| R240L | | | | | | F360L | Y372H |
| R240L | | | | | | F360L | Y372H |
| R240L | | | | | | F360L | Y372H |
| R240L | | | | | | F360L | Y372H |
| R240L | | | | | | F360L | Y372H |
| R240L | | | | | | F360L | Y372H |
| R240L | | | | | S350G | F360L | Y372H |
| R240L | | | | | S350G | F360L | Y372H |
| R240L | | | | | S350G | F360L | Y372H |
| R240L | | | | | S350G | F360L | Y372H |
| R240L | | | | | S350G | F360L | Y372H |
| R240L | | | | F341L | S350G | F360L | Y372H |
| R240L | | | | | S350G | F360L | Y372H |
| R240L | | | | | S350G | F360L | Y372H |
| R240L | | | | | | F360L | Y372H |
| R240L | Y294H | | | | | F360L | Y372H |
| R240L | | | | | | F360L | Y372H |
| R240L | | | | | | F360L | Y372H |
| R240L | | | | | | F360L | Y372H |
| R240L | | | | | | F360L | Y372H |
| R240L | | Y316N | | K342R | | F360L | Y372H |
| R240L | | | | | | F360L | Y372H |

| | | | | | | | |
|---|---|---|---|---|---|---|---|
| | P410L | G420A | L421W | V422L | E423R | I425S | V426* |
| | P410L | G420A | L421W | V422L | E423R | I425S | V426* |
| | P410L | G420A | L421W | V422L | E423R | I425S | V426* |
| N396H | P410L | G420A | L421W | V422L | E423R | I425S | V426* |
| | P410L | G420A | L421W | V422L | E423R | I425S | V426* |
| | P410L | G420A | L421W | V422L | E423R | I425T | V426* |
| | P410L | G420A | L421W | V422L | E423R | I425S | V426* |
| | P410L | G420A | L421W | V422L | E423R | I425S | V426* |

TABLE 16-continued

BoNT F PACE 3 (1216) Variants

| | | | | | | | |
|---|---|---|---|---|---|---|---|
| N396H | P410L | G420A | L421W | V422L | E423R | I425S | V426* |
| | P410L | G420A | L421W | V422L | E423R | I425S | V426* |
| | P410L | G420A | L421W | V422L | E423R | I425S | V426* |
| | P410L | G420A | L421W | V422L | E423R | I425S | V426* |
| N396H | P410L | G420A | L421W | V422L | E423R | I425S | V426* |
| | P410L | G420A | L421W | V422L | E423R | I425S | V426* |
| N396H | P410L | G420A | L421W | V422L | E423R | I425S | V426* |
| | P410L | G420A | L421W | V422L | E423R | I425S | V426* |
| N396H | P410L | | | | E423K | | |
| N396H | P410L | | | | E423K | | |
| N396H | P410L | | | | E423K | | |
| N396H | P410L | | | | E423K | | |
| N396H | P410L | | | | E423K | | |
| N396H | P410L | | | | E423K | | |
| N396H | P410L | | | | E423K | | |
| N396H | P410L | | | | E423K | | |

Unique amino acid sequences of BoNT F PACE 3 variants are provided in SEQ ID NOs: 122-137.

TABLE 17

BoNT F PACE 4 (1279) Variants

| Variant | | | | | | | | | |
|---|---|---|---|---|---|---|---|---|---|
| 1 | | | | N165S | S166Y | | | N184K | | R240L |
| 2 | | | | | S166Y | | | N184K | | R240L |
| 3 | | | D161N | N165T | S166Y | S167I | | N184K | | R240L |
| 4 | | | | | S166Y | | | N184K | | R240L |
| 5 | | | | | S166Y | | | N184K | | R240L |
| 6 | | | | N165S | S166Y | | | N184K | | R240L |
| 7 | | | | | S166Y | S167I | | N184K | | R240L |
| 8 | | | | | S166Y | | | N184K | | R240L |
| 9 | | | | | S166Y | S167I | | N184K | | R240L |
| 10 | | | | | S166Y | S167I | K172R | N184K | | R240L |
| 11 | | | | | S166Y | S167I | | N184K | | R240L |
| 12 | | | | | S166Y | | | N184K | | R240L |
| 13 | | | | | S166Y | S167I | | N184K | P197S | R240L |
| 14 | T79S | | | | S166Y | S167I | | N184K | | R240L |
| 15 | | | | | S166Y | S167I | | N184K | | R240L |
| 16 | | | D161N | | S166Y | S167I | | N184K | | R240L |
| 17 | | V106A | D161N | | S166Y | | | N184K | | E200K | R240L |
| 18 | | V106A | S136I | D161N | S166Y | | | N184K | | E200K | R240L |
| 19 | | V106A | D161N | | S166Y | | | N184K | | E200K | R240L |
| 20 | | V106A | D161N | | S166Y | | | N184K | | E200K | R240L |
| 21 | | V106A | D161N | | S166Y | | | N184K | | E200K | R240L |
| 22 | | V106A | D161N | | S166Y | | | N184K | | E200K | R240L |
| 23 | | | | | S166Y | | | N184K | | R240L |
| 24 | | V106A | D161N | | S166Y | | | N184K | | E200K | R240L |

| | | | | | | | | |
|---|---|---|---|---|---|---|---|---|
| | T335S | | F360L | | Y372H | L375R | | N396H | P410L | E423K |
| | | | F360L | I370V | Y372H | L375R | | N396H | P410L | E423K |
| | | | F360L | | Y372H | | | N396H | P410L | E423K |
| | | | F360L | | Y372H | L375R | | N396H | P410L | E423K |
| | | | F360L | | Y372H | L375R | | N396H | P410L | E423K |
| | T335S | N358T | F360L | | Y372H | L375R | | N396H | P410L | E423K |
| | | | F360L | | Y372H | L375R | | N396H | P410L | E423K |
| | | | F360L | | Y372H | L375R | | N396H | P410L | E423K |
| | T335S | | F360L | | Y372H | L375R | | N396H | P410L | E423K |
| | | | F360L | | Y372H | L375R | | N396H | P410L | E423K |
| | | | F360L | | Y372H | L375R | | N396H | P410L | E423K |
| | | | F360L | | Y372H | L375R | | N396H | P410L | E423K |
| | | | F360L | | Y372H | L375R | | N396H | P410L | E423K |
| A292S | | | F360L | | Y372H | L375R | | N396H | P410L | E423K |
| | | | F360L | | Y372H | | | N396H | P410L | E423K |
| | | | F360L | | Y372H | | | N396H | P410L | E423K |
| | | | F360L | | Y372H | | D382Y | N396H | P410L | E423K |

TABLE 17-continued

BoNT F PACE 4 (1279) Variants

| K283E | A291V | R303H | N339T | K347N | F360L | Y372H | N396H | P410L | E423K |
|---|---|---|---|---|---|---|---|---|---|
| K283E | | | N339T | | F360L | Y372H | N396H | P410L | E423K |
| | A291V | | | | F360L | Y372H | N396H | P410L | E423K |
| | | | | | F360L | Y372H | N396H | P410L | E423K |
| | | | | K347N | F360L | Y372H | N396H | P410L | E423K |
| | | R303H | | | F360L | Y372H | N396H | P410L | E423K |
| | | | | | F360L | Y372H | N396H | P410L | E423K |

Unique amino acid sequences of BoNT F PACE 4 variants are provided in SEQ ID NOs: 138-154.

TABLE 18

BoNT F PACE 5 (1285) Variants

| Variant | V106A | E121D/K | D161N | N165T/S | S166Y | S167I | K172R | N184K | V193M | E200G/K | Y210C | R240L | Y253S | D274E |
|---|---|---|---|---|---|---|---|---|---|---|---|---|---|---|
| 1 | | | | | S166Y | | | N184K | | E200G | | R240L | | |
| 2 | | E121D | D161N | N165T | S166Y | S167I | | N184K | | | | R240L | | |
| 3 | | | | | S166Y | | | N184K | | E200G | | R240L | | |
| 4 | | E121D | D161N | N165T | S166Y | S167I | | N184K | | | | R240L | | |
| 5 | | E121D | D161N | N165T | S166Y | S167I | | N184K | | | | R240L | | |
| 6 | | | D161N | N165S | S166Y | S167I | | N184K | | | | R240L | | |
| 7 | | | D161N | N165T | S166Y | S167I | | N184K | | | | R240L | | |
| 8 | | | D161N | N165T | S166Y | S167I | | N184K | | | | R240L | | |
| 9 | | | D161N | N165T | S166Y | S167I | K172R | N184K | | | | R240L | | |
| 10 | | E121K | D161N | N165T | S166Y | S167I | | N184K | | | | R240L | | |
| 11 | | E121K | D161N | N165T | S166Y | S167I | | N184K | | | | R240L | | |
| 12 | | E121K | D161N | N165T | S166Y | S167I | | N184K | | | | R240L | | D274E |
| 13 | | E121K | D161N | N165T | S166Y | S167I | | N184K | | | | R240L | | |
| 14 | | E121K | D161N | N165T | S166Y | S167I | | N184K | V193M | | | R240L | Y253S | |
| 15 | V106A | | D161N | | S166Y | | | N184K | | E200K | | R240L | | |
| 16 | V106A | | D161N | | S166Y | | | N184K | | E200K | | R240L | | |
| 17 | V106A | | D161N | | S166Y | | | N184K | | E200K | | R240L | | |
| 18 | V106A | | D161N | | S166Y | | | N184K | | E200K | Y210C | R240L | | |
| 19 | V106A | | D161N | | S166Y | | | N184K | | E200K | | R240L | | |
| 20 | | | | | S166Y | | | N184K | | | | R240L | | |
| 21 | V106A | | D161N | | S166Y | | | N184K | | E200K | | R240L | | |

| T279C | T299M | T335S | K347N | F360L | Y372H | L375R | S389N | F392Y |
|---|---|---|---|---|---|---|---|---|
| | | | | F360L | Y372H | L375R | | F392Y |
| | | | | F360L | Y372H | | | |
| | | | | F360L | Y372H | L375R | | |
| | | | | F360L | Y372H | | | |
| | | | | F360L | Y372H | | | |
| | | | | F360L | Y372H | | | |
| | | | | F360L | Y372H | | | |
| | | | | F360L | Y372H | L375R | | |
| | | | | F360L | Y372H | L375R | S389N | |
| | | | | F360L | Y372H | L375R | | |
| | | | | F360L | Y372H | L375R | | |
| | | | | F360L | Y372H | L375R | | |
| | | | | F360L | Y372H | L375R | | |
| | | | | F360L | Y372H | | | |
| | | T335S | | F360L | Y372H | | | |
| | | | | F360L | Y372H | | | |
| | | | | F360L | Y372H | | | |
| | | | K347N | F360L | Y372H | | | |
| T279C | | | | F360L | Y372H | | | |
| | T299M | | | F360L | Y372H | | | |

| N396H | P410L | G420A | L421W | V422L | E423K/R | I425S | V426* |
|---|---|---|---|---|---|---|---|
| N396H | P410L | | | | E423K | | |
| N396H | P410L | | | | E423K | | |
| N396H | P410L | | | | E423K | | |
| N396H | P410L | | | | E423K | | |
| N396H | P410L | | | | E423K | | |
| N396H | P410L | | | | E423K | | |
| N396H | P410L | | | | E423K | | |
| N396H | P410L | | | | E423K | | |
| N396H | P410L | | | | E423K | | |
| N396H | P410L | | | | E423K | | |
| N396H | P410L | | | | E423K | | |
| N396H | P410L | | | | E423K | | |
| N396H | P410L | | | | E423K | | |
| N396H | P410L | | | | E423K | | |
| N396H | P410L | G420A | L421W | V422L | E423R | I425S | V426* |
| N396H | P410L | | | | E423K | | |
| N396H | P410L | | | | E423K | | |

TABLE 18-continued

BoNT F PACE 5 (1285) Variants

| | | | | | | | |
|---|---|---|---|---|---|---|---|
| N396H | P410L | | | | E423K | | |
| N396H | P410L | G420A | L421W | V422L | E423R | I425S | V426* |
| N396H | P410L | | | | E423K | | |
| N396H | P410L | | | | E423K | | |

Unique amino acid sequences of BoNT F PACE 5 variants are provided in SEQ ID NOs: 155-170.

TABLE 19

BoNT F PACE 6 (160508) Variants

| Variant | | | | | | | | | | | | | |
|---|---|---|---|---|---|---|---|---|---|---|---|---|---|
| 1 | | | | | | S166Y | | | | | T214S | | |
| 2 | | | | | | S166Y | | | | | T214S | | |
| 3 | | | | | | S166Y | | | | | | Y237S | |
| 4 | | | | | | S166Y | | | | | | | |
| 5 | | V106A | | | | S166Y | | | | | | | |
| 6 | | | | | | S166Y | | | | | T214S | | |
| 7 | | | | | | S166Y | | | Y201D | N211D | | | |
| 8 | | V106A | | | | S166Y | | | | | T214S | | |
| 9 | | | | | | S166Y | S176N | | | | | | |
| 10 | R41H | | | | | S166Y | | | | | | | |
| 11 | R41H | | | | | S166Y | | | | | | | |
| 12 | | | | | | S166Y | | | | | | | |
| 13 | | D55N | K96N | | Y113S | S166Y | | | | | | | |
| 14 | | | | | | S166Y | | N184H | | | | | |
| 15 | | | | | | S166Y | | | | | | | |
| 16 | | | | | | S166Y | | | | | | | |
| 17 | R41H | | | | | S166Y | | | | | | | R240L |
| 18 | | | | | | S166Y | | | | | | | R240L |
| 19 | | V106A | | | | S166Y | | | | | | | R240L |
| 20 | R41H | | | | | S166Y | | | | | | | R240L | E259G |
| 21 | | | | | | S166Y | | | | | | | R240L | E259G |
| 22 | R41H | | Q109H | | | S166Y | | | | | | | R240L |
| 23 | | | | | | S166Y | | | | | | | R240L |
| 24 | | | | | | S166Y | | | | | | | R240L |

| | | | | | | | | |
|---|---|---|---|---|---|---|---|---|
| | | T299M | | | | | A330E | |
| | | | | | N305T | | | |
| | | | | | | N329D | | |
| | | | | | | | | E338K |
| F267L | | | | | | | | |
| | I286N | | | | | | | |
| F267L | | | R300H | R303H | | | | |

| | | | | | | | |
|---|---|---|---|---|---|---|---|
| | | | | | | S415P | |
| | | | | | | S415P | |
| | | | | N379D | | | |
| | | | | | | | I416V |
| | | | | | | S415P | |
| | | Y372H | | N379D | | | |
| | | | | N379D | | | |
| | | | | N379D | | | |
| | | | | N379D | | | |
| | | | | N379D | | | |
| | | | | | D414G | | |
| | | | | N379D | | | |
| | | | F374L | N379D | | | |
| | | | | N379D | | | |
| F360L | | Y372H | | | D414G | | |
| | | Y372H | | | | | |
| F360L | | Y372H | | | | | |
| F360L | | Y372H | | | D414G | | |
| F360L | | Y372H | | | | | |
| F360L | V362A | Y372H | | | D414G | | |
| | | Y372H | | | | | |
| | | Y372H | | | | | |

Unique amino acid sequences of BoNT F PACE 6 variants are provided in SEQ ID NOs: 171-189.

TABLE 20

BoNT F PACE 7 (160520) Variants

| Variant | | | | | | | | | |
|---|---|---|---|---|---|---|---|---|---|
| 1 | | | S166Y | N184D | | | | F374C | |
| 2 | S100I | | S166Y | | | | | | |
| 3 | | E121D | S166Y | | F267L | | D355G | | |
| 4 | | | S166Y | | | | | | |
| 5 | | | S166Y | | | | | | |
| 6 | | | S166Y | | | | | | |
| 7 | A103V | | S166Y | | | | | | |
| 8 | | | S166Y | | | | | | |
| 9 | | | S166Y | | | A330E | | | |
| 10 | | | S166Y | | | | | | F428S |
| 11 | | | S166Y | | | | | | |
| 12 | | | S166Y | | | | | | |
| 13 | | | S166Y | | | | | | |
| 14 | | | S166Y | P221R | | | | | |
| 15 | | | S166Y | | | | A307S | | |
| 16 | | | S166Y | | A292S | | | | |

Unique amino acid sequences of BoNT F PACE 7 variants are provided in SEQ ID NOs: 190-198.

TABLE 21

BoNT F PACE 8 (160720) Variants

| Variant | | | | | | | | | |
|---|---|---|---|---|---|---|---|---|---|
| 1 | | | S166Y | N184D | | | | F374C | |
| 2 | S100I | | S166Y | | | | | | |
| 3 | | E121D | S166Y | | F267L | | D355G | | |
| 4 | | | S166Y | | | | | | |
| 5 | | | S166Y | | | | | | |
| 6 | | | S166Y | | | | | | |
| 7 | A103V | | S166Y | | | | | | |
| 8 | | | S166Y | | | | | | |
| 9 | | | S166Y | | | A330E | | | |
| 10 | | | S166Y | | | | | | F428S |
| 11 | | | S166Y | | | | | | |
| 12 | | | S166Y | | | | | | |
| 13 | | | S166Y | | | | | | |
| 14 | | | S166Y | P221R | | | | | |
| 15 | | | S166Y | | | A307S | | | |
| 16 | | | S166Y | | A292S | | | | |

Unique amino acid sequences of BoNT F PACE 8 variants are provided in SEQ ID NOs: 199-208.

TABLE 22

BoNT F PACE 9 (160829) Variants

| Variant | | | |
|---|---|---|---|
| 1 | | S166Y | K283R |
| 2 | | S166Y | |
| 3 | N101T | S166Y | |

Unique amino acid sequences of BoNT F PACE 9 variants are provided in SEQ ID NOs: 209-211.

TABLE 23

BoNT F PACE 10 (2012a) Variants

| Variant | | | | | | | | | | | | | |
|---|---|---|---|---|---|---|---|---|---|---|---|---|---|
| 1 | | | | V106A | Y113S | | S166Y | | S176G | N184S | E200K | | |
| 2 | | A63T | E66D | | | | S166Y | D175G | | N184K | E200G | | |
| 3 | | | | V106A | Y113D | | S166Y | | | | E200K | | |
| 4 | | | E66K | V106A | Y113D | | S166Y | | | N184H | E200K | | |
| 5 | | | | V106A | Y113S | | S166Y | | S176G | | E200K | | |
| 6 | | | | V106A | Y113S | | S166Y | | | N184H | E200K | G209D | |
| 7 | N11S | | | V106A | Y113D | | S166Y | | | | E200K | | T214A |
| 8 | | | | V106A | Y113D | H129Y | S166Y | | | | E200K | | |

TABLE 23-continued

BoNT F PACE 10 (2012a) Variants

| | | | | | | | | | | | |
|---|---|---|---|---|---|---|---|---|---|---|---|
| 9 | | | Y113D | S166Y | | N184H | E200K | | | | |
| 10 | | V106A | | S166Y | | N184S | E200K | | | | |
| 11 | | V106A | | S166Y | | N184S | E200K | | | | |
| 12 | | | Y113D | S166Y | S167C | N184H | E200K | | | | |
| 13 | | | Y113D | S166Y | | N184H | E200K | | | | |
| 14 | | | Y113D | S166Y | | N184H | E200K | | | | |
| 15 | N76D | V106A | Y113D | S166Y | | N184H | E200K | | | | |
| 16 | | V106A | | S166Y | | N184S | E200K | | | | |
| 17 | | | | S166Y | | N184K | E200K | | | | |
| 18 | | V106A | | S166Y | | N184K | E200K | | | | |
| 19 | | V106A | | S166Y | | N184K | E200K | | | | |
| 20 | | V106A | | S166Y | | N184K | E200K | | | | |
| 21 | | V106A | | S166Y | | N184K | E200K | | | | |
| 22 | | | | S166Y | | N184K | E200K | | | | |
| 23 | | V106A | | S166Y | | N184K | E200K | | | | |
| 24 | | V106A | | S166Y | | N184K | E200K | | | | |

| | | | | | | | | | | | | |
|---|---|---|---|---|---|---|---|---|---|---|---|---|
| R240L | | F267L | | F360L | Y372H | | P410L | | L421W | V422L | E423R | I425S V426* |
| R240L | | | | F360L | Y372H | | P410L | G420A | L421W | V422L | E423R | I425S V426* |
| R240L | | | | F360L | Y372H | | P410L | G420V | | | | |
| R240L | T243A | | | F360L | Y372H | N396H | P410L | G420V | | V422I | | |
| R240L | | | | F360L | Y372H | | P410L | | L421W | V422L | E423R | I425S V426* |
| R240L | | | | F360L | Y372H | | P410L | | L421W | V422L | E423R | I425S V426* |
| R240L | | | | F360L | Y372H | | P410L | G420V | | | | |
| R240L | | | | F360L | Y372H | | P410L | G420V | | | | |
| R240L | | | | F360L | Y372H | | P410L | G420A | L421W | V422L | E423R | I425S V426* |
| R240L | | | | F360L | Y372H | | P410L | G420A | L421W | V422L | E423R | I425S V426* |
| R240L | | | S350G | F360L | Y372H | N396H | P410L | G420A | L421W | V422L | E423R | I425S V426* |
| R240L | | | S350G | F360L | Y372H | N396H | P410L | G420A | L421W | V422L | E423R | I425S V426* |
| R240L | | I277L | S350G | F360L | Y372H | | P410L | G420A | L421W | V422L | E423R | I425S V426* |
| R240L | | | | F360L | Y372H | | P410L | G420A | L421W | V422L | E423R | I425S V426* |
| R240L | | | S350G | F360L | Y372H | | P410L | G420A | L421W | V422L | E423R | I425S V426* |
| R240L | | | S350G | F360L | Y372H | N396H | P410L | G420A | L421W | V422L | E423R | I425S V426* |
| R240L | Y244C | | S350I | F360L | Y372H | N396H | P410L | | | | E423K | |
| R240L | Y244C | | | F360L | Y372H | N396H | P410L | | | | E423K | |
| R240L | Y244C | | | F360L | Y372H | N396H | P410L | | | | E423K | |
| R240L | Y244C | | | F360L | Y372H | N396H | P410L | | | | E423K | |
| R240L | Y244C | | | F360L | Y372H | N396H | P410L | | | | E423K | |
| R240L | Y244C | | | F360L | Y372H | N396H | P410L | | | | E423K | |
| R240L | Y244C | | | F360L | Y372H | N396H | P410L | | | | E423K | |

Unique amino acid sequences of BoNT F PACE 10 variants are provided in SEQ ID NOs: 212-228.

TABLE 24

BoNT F PACE 11 (2020a) Variants

| Variant | | | | | | | |
|---|---|---|---|---|---|---|---|
| 1 | E66D | | | S166Y | | D175G | N184K |
| 2 | E66D | | | S166Y | | D175G | N184K |
| 3 | E66D | | | S166Y | | D175G | N184K |
| 4 | E66D | | | S166Y | | D175G | N184K |
| 5 | | | | S166Y | | D175G | N184K |
| 6 | E66D | | | S166Y | | D175G | N184K |
| 7 | E66D | | | S166Y | | D175G | N184K |
| 8 | E66D | | | S166Y | | D175G | N184K |
| 9 | | | V106A | S166Y | S167I | | |
| 10 | | | V106A | S166Y | S167I | | |
| 11 | | | V106A | S166Y | S167I | | |
| 12 | | N76D | V106A | S166Y | S167I | | |
| 13 | | | V106A | S166Y | S167I | | |
| 14 | | | V106A | S166Y | S167I | | |
| 15 | | | V106A | S166Y | S167I | | |
| 16 | | | V106A | S166Y | S167I | | |
| 17 | | | | S166Y | | | N184K |
| 18 | | | | S166Y | | | N184K |
| 19 | | | | S166Y | | | N184K |
| 20 | | | | S166Y | | | N184K |

TABLE 24-continued

| | BoNT F PACE 11 (2020a) Variants | | | | | | |
|---|---|---|---|---|---|---|---|
| 21 | | | | | S166Y | | N184K |
| 22 | | | | | S166Y | | N184K |
| 23 | | S70F | | | S166Y | | N184K |
| 24 | S70F | | | E164K | S166Y | | N184K |

| Variant | | | | | | | |
|---|---|---|---|---|---|---|---|
| 1 | | E200G | | | S224I | R240F | |
| 2 | | E200G | Y210H | | S224I | R240F | |
| 3 | | E200G | | | S224I | R240F | |
| 4 | | E200G | | E215G | | R240L | |
| 5 | | E200G | | T214I | | R240F | |
| 6 | | E200G | | | S224I | R240F | |
| 7 | | E200G | | | S224I | R240F | |
| 8 | | E200G | | E215G | | R240L | Y244C |
| 9 | | E200G | | | S224I | R240L | |
| 10 | | E200G | | | S224I | R240L | |
| 11 | | E200G | | | S224I | R240L | |
| 12 | | E200G | | | S224I | R240L | |
| 13 | | E200G | | | S224I | R240L | |
| 14 | | E200G | | | S224I | R240L | |
| 15 | | E200G | | | S224I | R240L | |
| 16 | | E200G | | | S224I | R240L | |
| 17 | | E200G | | | S224I | R240F | |
| 18 | | E200G | | | S224I | R240F | |
| 19 | | E200G | | | S224I | R240F | |
| 20 | Y199H | E200G | | | S224I | R240F | |
| 21 | | E200G | | | S224I | R240F | |
| 22 | | E200G | | | S224I | R240F | |
| 23 | | E200G | | | S224I | R240F | |
| 24 | | E200G | | | S224I | R240F | |

| | | | | | | | |
|---|---|---|---|---|---|---|---|
| | | R303H | P309T | | F360L | | Y372H |
| | | | | | F360L | | Y372H |
| | | | | | F360L | | Y372H |
| | | | | | F360L | K371E | Y372H |
| | | | | | F360L | | Y372H |
| | | | | | F360L | | Y372H |
| | | | | | F360L | | Y372H |
| | | | | | F360L | K371E | Y372H |
| | | | | S350G | F360L | | Y372H |
| | | | | S350G | F360L | | Y372H |
| | | | | S350G | F360L | | Y372H |
| | | | | S350G | F360L | | Y372H |
| | | | | S350G | F360L | | Y372H |
| | | | | S350G | F360L | | Y372H |
| | | | | S350G | F360L | | Y372H |
| | | | | S350G | F360L | | Y372H |
| | | | | T335S | F360L | | Y372H |
| | | N276T | | T335S | F360L | | Y372H |
| | | | | T335S | F360L | | Y372H |
| | | | | T335S | F360L | | Y372H |
| A258S | N276S | | | | F360L | | Y372H | L375R |
| | | | | T335S | F360L | | Y372H |
| | | | | | F360L | | Y372H | L375R |

| | | | | | | | |
|---|---|---|---|---|---|---|---|
| | | P410L | | G420A | L421W | V422L | E423R | I425S | V426* |
| | | P410L | | G420A | L421W | V422L | E423R | I425S | V426* |
| | | P410L | | G420A | L421W | V422L | E423R | I425S | V426* |
| | | P410L | | G420A | L421W | V422L | E423R | I425S | V426* |
| | | P410L | | G420A | L421W | V422L | E423R | I425S | V426* |
| | | P410L | | G420A | L421W | V422L | E423R | I425S | V426* |
| | | P410L | | G420A | L421W | V422L | E423R | I425S | V426* |
| | | P410L | | G420A | L421W | V422L | E423R | I425S | V426* |
| N396H | P410L | | G420A | L421W | V422L | E423R | I425S | V426* |
| N396H | P410L | | G420A | L421W | V422L | E423R | I425S | V426* |
| N396H | P410L | | G420A | L421W | V422L | E423R | I425S | V426* |
| N396H | P410L | | G420A | L421W | V422L | E423R | I425S | V426* |
| N396H | P410L | | G420A | L421W | V422L | E423R | I425S | V426* |
| N396H | P410L | | G420A | L421W | V422L | E423R | I425S | V426* |
| N396H | P410L | | G420A | L421W | V422L | E423R | I425S | V426* |
| N396H | P410L | | G420A | L421W | V422L | E423R | I425S | V426* |
| N396H | P410L | D418Y | | | | E423K | | |
| N396H | P410L | D418Y | | | | E423K | | |
| N396H | P410L | D418Y | | | | E423K | | |
| N396H | P410L | D418Y | | | | E423K | | |
| N396H | P410L | D418Y | | | | E423K | | |

TABLE 24-continued

BoNT F PACE 11 (2020a) Variants

| | | | | |
|---|---|---|---|---|
| N396H | P410L | | | E423K |
| N396H | P410L | D418Y | | E423K |
| N396H | P410L | | | E423K |

Unique amino acid sequences of BoNT F PACE 11 variants are provided in SEQ ID NOs: 229-241.

TABLE 25

BoNT F PACE 11 (2020b) Variants

| Variant | | | | | | | | | | | |
|---|---|---|---|---|---|---|---|---|---|---|---|
| 1 | E66D | | | S166Y | | D175G | N184K | E200G | | | R240F |
| 2 | E66D | | | S166Y | | D175G | N184K | E200G | | S224I | R240F |
| 3 | E66D | | | S166Y | | D175G | N184K | E200G | | S224I | R240F |
| 4 | E66D | | | S166Y | | D175G | N184K | E200G | | S224I | R240F |
| 5 | E66D | | | S166Y | | D175G | N184K | E200G | | S224I | R240F |
| 6 | E66D | | | S166Y | | D175G | N184K | E200G | | S224I | R240F |
| 7 | E66D | | | S166Y | | D175G | N184K | E200G | T214G | | R240L |
| 8 | | | V106A | S166Y | S167I | | | E200G | N211H | S224I | R240L |
| 9 | | | V106A | S166Y | S167I | | | E200G | | S224I | R240L |
| 10 | | | V106A | S166Y | S167I | | | E200G | | S224I | R240L |
| 11 | | N76D | V106A | S166Y | S167I | | | E200G | | S224I | R240L |
| 12 | | | V106A | S166Y | S167I | | | E200G | | S224I | R240L |
| 13 | | | V106A | S166Y | S167I | | | E200G | | S224I | R240L |
| 14 | | | | S166Y | | | N184K | E200G | | S224I | R240F |
| 15 | | | | S166Y | | | N184K | E200G | | | R240F |
| 16 | | S70F | | S166Y | | | N184K | E200G | | S244I | R240F |
| 17 | A63D | | | S166Y | | | N184K | E200G | | S244I | R240L |
| 18 | | | | S166Y | | | N184K | E200G | | | R240F |
| 19 | | S70F | | S166Y | | | N184K | E200G | | S244I | R240L |

| | | | | | | | |
|---|---|---|---|---|---|---|---|
| | | | F360L | | Y372H | | |
| | | | F360L | | Y372H | | |
| | | | F360L | | Y372H | | |
| | | | F360L | | Y372H | | |
| | | | F360L | | Y372H | | |
| | | | F360L | | Y372H | | N379D | |
| | | | F360L | K371E | Y372H | | |
| | | S350G | F360L | | Y372H | | N396H |
| | | S350G | F360L | | Y372H | | N396H |
| | | S350G | F360L | | Y372H | | N396H |
| | | S350G | F360L | | Y372H | | N396H |
| | | S350G | F360L | | Y372H | | N396H |
| | | S350G | F360L | | Y372H | | N396H |
| | | | F360L | | Y372H | | N396H |
| | T335S | | F360L | | Y372H | | N396H |
| | | | F360L | | Y372H | L375R | N396H |
| G241S | | | F360L | | Y372H | | N396H |
| | | | F360L | | Y372H | | N396H |
| | | | F360L | | Y372H | L375R | N396H |

| | | | | | | | |
|---|---|---|---|---|---|---|---|
| | P410L | | P410L | G420A | L421W | V422L | E423R | I425S V426* |
| | P410L | | P410L | G420A | L421W | V422L | E423R | I425S V426* |
| | P410L | | P410L | G420A | L421W | V422L | E423R | I425S V426* |
| | P410L | | P410L | G420A | L421W | V422L | E423R | I425S V426* |
| | P410L | | P410L | G420A | L421W | V422L | E423R | I425S V426* |
| | P410L | | P410L | G420A | L421W | V422L | E423R | I425S V426* |
| | P410L | | P410L | G420A | L421W | V422L | E423R | I425S V426* |
| | P410L | | P410L | G420A | L421W | V422L | E423R | I425S V426* |
| | P410L | | P410L | G420A | L421W | V422L | E423R | I425S V426* |
| | P410L | | P410L | G420A | L421W | V422L | E423R | I425S V426* |
| | P410L | | P410L | G420A | L421W | V422L | E423R | I425S V426* |
| | P410L | | P410L | G420A | L421W | V422L | E423R | I425S V426* |
| | P410L | | | | | | E423K | |
| | P410L | D418Y | | | | | E423K | |
| | P410L | | | | | | E423K | |
| | P410L | | | | | | E423K | |
| | P410L | | | | | | E423K | |
| | P410L | | | | | | E423K | |

Unique amino acid sequences of BoNT F PACE 11 variants are provided in SEQ ID NOs: 242-253.

TABLE 26

BoNT F PACE 11 (2020c) Variants

| Variant | | | | | | | | | | | | | | |
|---|---|---|---|---|---|---|---|---|---|---|---|---|---|---|
| 1 | E66D | | | S166Y | | D175G | N184K | | E200G | | | | | R240L |
| 2 | E66D | | | S166Y | | D175G | N184K | | E200G | | | | | R240F |
| 3 | E66D | | | S166Y | | D175G | N184K | | E200G | | | | | R240F |
| 4 | E66D | | | S166Y | | D175G | N184K | | E200G | | | | S224I | R240F |
| 5 | E66D | | | S166Y | | D175G | N184K | | E200G | | | | | R240F |
| 6 | E66D | | | S166Y | | D175G | N184K | | E200G | | | | S224I | R240F |
| 7 | E66D | | | S166Y | | D175G | N184K | | E200G | | | | S224I | R240F |
| 8 | E66D | | | S166Y | | D175G | N184K | | E200G | | | | | R240L |
| 9 | | | Y113D | S166Y | S167C | | N184H | | E200G | | | | | R240L |
| 10 | | V106A | Y113D | S166Y | S167I | | N184H | | E200G | | Y210H | | | R240L |
| 11 | | | Y113D | S166Y | S167C | | N184H | | E200G | | | | | R240L |
| 12 | N101I | | | S166Y | S167C | | N184H | | E200G | | | | | R240L |
| 13 | | V106A | Y113D | S166Y | | | N184S | | E200G | | | | | R240L |
| 14 | | | Y113D | S166Y | S167C | | N184H | | E200G | | | | | R240L |
| 15 | | V106A | | S166Y | S167I | | N184H | | E200A | | | | | R240L |
| 16 | | | | S166Y | | | N184K | | E200G | | | | S224I | R240F |
| 17 | | | | S166Y | | | N184K | | E200G | S207N | | | S224I | R240F |
| 18 | | | | S166Y | | | N184K | | E200G | | | | S224I | R240F |
| 19 | | | | S166Y | | | N184K | | E200G | | | | S224I | R240L |
| 20 | | V106A | | S166Y | | | N184K | | E200G | | | E215K | S224I | R240L |
| 21 | | | | S166Y | | | N184K | I190V | E200G | | | | S224I | R240L |
| 22 | | | | S166Y | | | N184K | | E200G | | | | S224I | R240F |

| | | | | | | | |
|---|---|---|---|---|---|---|---|
| | | | F360L | K371E | Y372H | | |
| | | | F360L | | Y372H | | |
| | | | F360L | | Y372H | | |
| | | | F360L | | Y372H | | |
| | | | F360L | | Y372H | | |
| | | | F360L | | Y372H | | |
| | | | F360L | | Y372H | | |
| | | | F360L | K371E | Y372H | | |
| | | S350G | F360L | | Y372H | | |
| | | S350G | F360L | | Y372H | | |
| | | S350G | F360L | | Y372H | | |
| | | S350G | F360L | | Y372H | | |
| | | S350G | F360L | | Y372H | | N379D |
| | | S350G | F360L | | Y372H | | |
| | | S350G | F360L | | Y372H | | |
| | T335S | | F360L | | Y372H | | |
| | | | F360L | | Y372H | L375R | |
| | T335S | | F360L | | Y372H | | |
| | T335S | | F360L | | Y372H | | |
| R244C | | | F360L | K371E | Y372H | | |
| | T335S | | F360L | | Y372H | | |
| E310G | T335S | | F360L | | Y372H | | |

| | | | | | | | | |
|---|---|---|---|---|---|---|---|---|
| | P410L | | G420A | L421W | V422L | E423R | I425S | V426* |
| | P410L | | G420A | L421W | V422L | E423R | I425S | V426* |
| | P410L | | G420A | L421W | V422L | E423R | I425S | V426* |
| | P410L | | G420A | L421W | V422L | E423R | I425S | V426* |
| | P410L | | G420A | L421W | V422L | E423R | I425S | V426* |
| | P410L | | G420A | L421W | V422L | E423R | I425S | V426* |
| | P410L | | G420A | L421W | V422L | E423R | I425S | V426* |
| | P410L | | G420A | L421W | V422L | E423R | I425S | V426* |
| | P410L | | G420A | L421W | V422L | E423R | I425S | V426* |
| | P410L | | G420A | L421W | V422L | E423R | I425S | V426* |
| | P410L | | G420A | L421W | V422L | E423R | I425S | V426* |
| | P410L | | G420A | L421W | V422L | E423R | I425S | V426* |
| N396H | P410L | | G420A | L421W | V422L | E423R | I425S | V426* |
| | P410L | | G420A | L421W | V422L | E423R | I425S | V426* |
| N396H | P410L | | G420A | L421W | V422L | E423R | I425S | V426* |
| N396H | P410L | D418Y | | | | E423K | | |
| N396H | P410L | D418Y | | | | E423K | | |
| N396H | P410L | | | | | E423K | | |
| N396H | P410L | D418Y | | | | E423K | | |
| N396H | P410L | | | | | E423K | | |
| N396H | P410L | D418Y | | | | E423K | | |
| N396H | P410L | D418Y | | | | E423K | | |

Unique amino acid sequences of BoNT F PACE 11 variants are provided in SEQ ID NOs: 254-268.

TABLE 27

BoNT F PACE 11 (2020d) Variants

| Variant | | | | | | | | |
|---|---|---|---|---|---|---|---|---|
| 1 | | | E66D | | | | | |
| 2 | | | E66D | | | | | |
| 3 | | | E66D | | | | | |
| 4 | | A63T | E66D | | | | | |
| 5 | | | E66D | | | | | |
| 6 | | | E66D | | | | | |
| 7 | | | | | | V106A | | |
| 8 | | | | | | | Y113D | |
| 9 | | | | N76D | | | Y113D | |
| 10 | | | | | | | Y113D | |
| 11 | | | | | | V106A | Y113D | |
| 12 | D60Y | | | | | V106A | | |
| 13 | | | | | | | Y113D | |
| 14 | | | | | | | | |
| 15 | N40T | | | | E105A | | | |
| 16 | | | | | E105A | | | |
| 17 | | | | | | | | |
| 18 | | | | | | | | H129Y |
| 19 | | | | | | | | |
| 20 | | | | S70F | | | | |

| Variant | | | | | | | |
|---|---|---|---|---|---|---|---|
| 1 | | S166Y | | D175G | N184K | | E200G |
| 2 | | S166Y | | D175G | N184K | | E200G |
| 3 | | S166Y | | D175G | N184K | | E200G |
| 4 | I139V | S166Y | | D175G | N184K | | E200G |
| 5 | | S166Y | | D175G | N184K | | E200G |
| 6 | | S166Y | | D175G | N184K | | E200G |
| 7 | | S166Y | | | N184S | | E200K |
| 8 | | S166Y | S167C | | N184H | | E200K |
| 9 | | S166Y | S167C | | N184H | | E200K |
| 10 | | S166Y | S167C | | N184H | | E200K |
| 11 | | S166Y | S167C | | N184H | | E200K |
| 12 | | S166Y | | | N184S | | E200K |
| 13 | | S166Y | | | N184H | | E200K |
| 14 | | S166Y | | | N184K | | E200K |
| 15 | | S166Y | | | N184K | | E200K |
| 16 | | S166Y | | | N184K | Y199H | E200K |
| 17 | | S166Y | | | N184K | | E200G |
| 18 | | S166Y | | | N184K | | E200K |
| 19 | | S166Y | | | N184K | | E200K |
| 20 | E164K | S166Y | | | N184K | | E200G |

Unique amino acid sequences of BoNT F PACE 11 variants are provided in SEQ ID NOs: 269-285.

Example 5

Characterization of Evolved BoNT Proteases

This example describes expression and isolation of evolved BoNT F proteases. An expression construct comprising a nucleic acid encoding PACE-2020 BoNT F protease variant L2A was produced. The expression construct also included an N-terminal maltose binding protein (MBP) tag and a poly-histidine C-terminal tag. Transformed cells were subjected to cell disruptor lysis, following by primary purification using Ni-NTA and secondary purification by amylose column (which binds to the MBP).

Figure 38A:
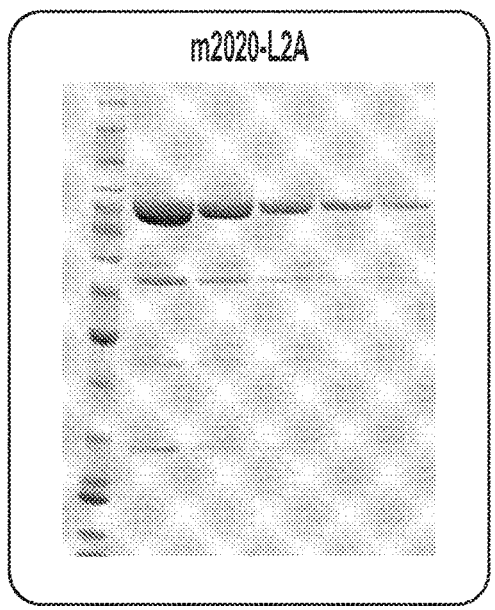
FIGS. 38A-38B show protease expression and isolation of evolved BoNT proteases.
Figure 38B:
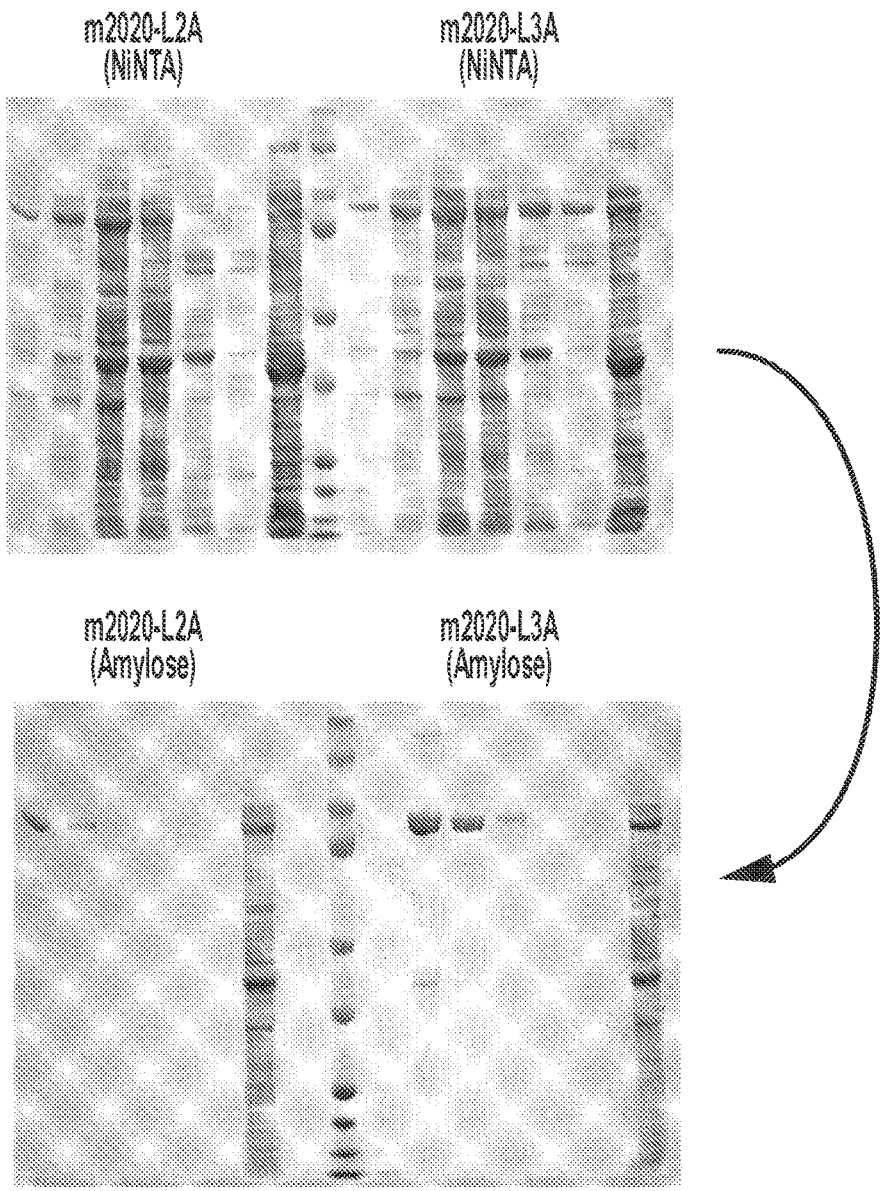

FIGS. 38A-38B show protease expression and isolation of evolved BoNT proteases. FIG. 38A shows a Western blot of evolved BoNT F protease m2020-L2A ("m" indicates a maltose-binding protein tag on the N-terminus of the protein). FIG. 38B shows a Western blot of Ni-NTA (top) purified BoNT F proteases m2020-L2A and m2020-L3A and subsequent Amylose-purification of BoNT F proteases m2020-L2A and m2020-L3A.

Figure 39:
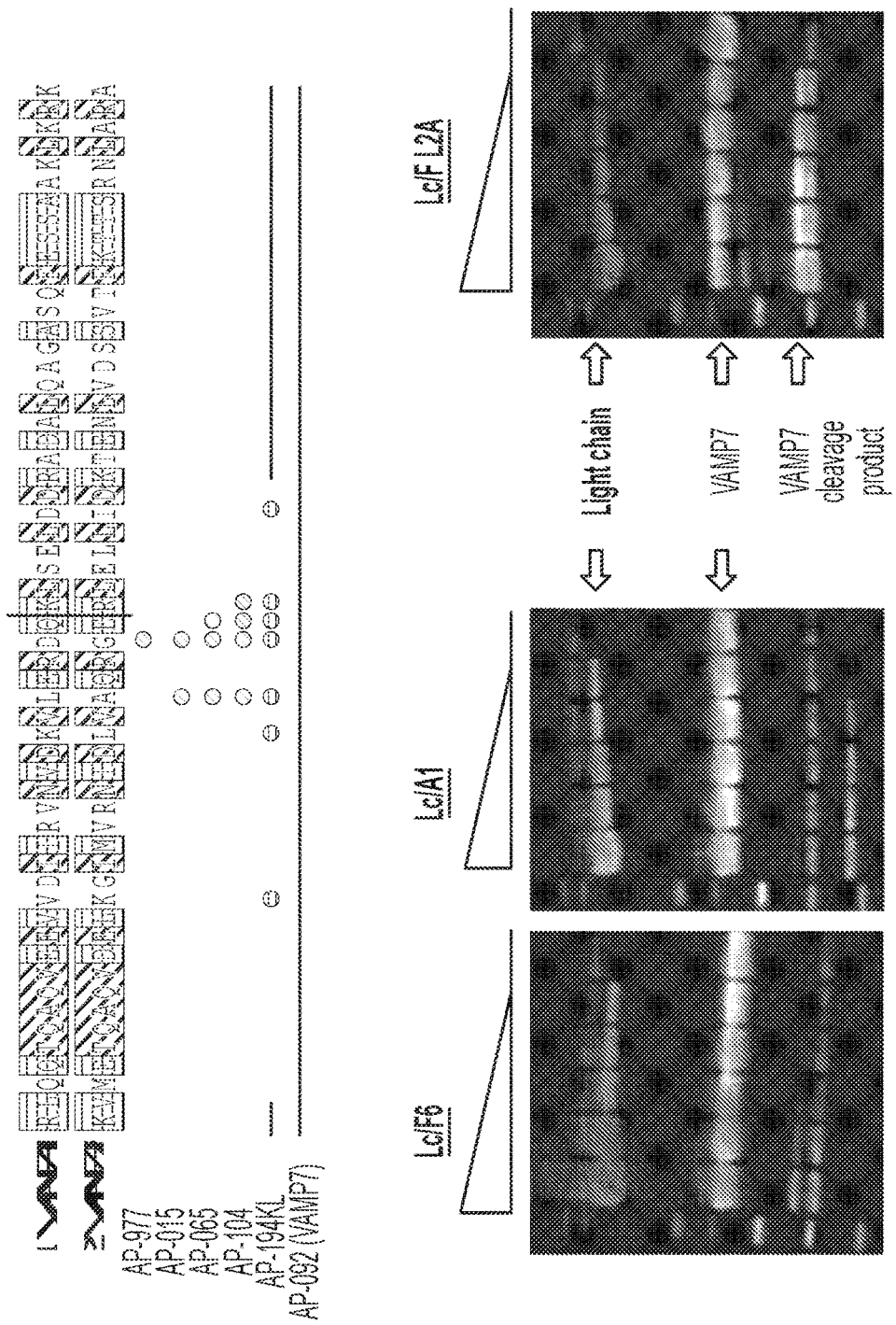
FIG. 39 shows data indicating that BoNT F variant 2020-L2A protease is active in vitro, as measured by a VAMP7 cleavage assay. SEQ ID NOs: 394-395 (top and bottom) are shown.
Figure 40:
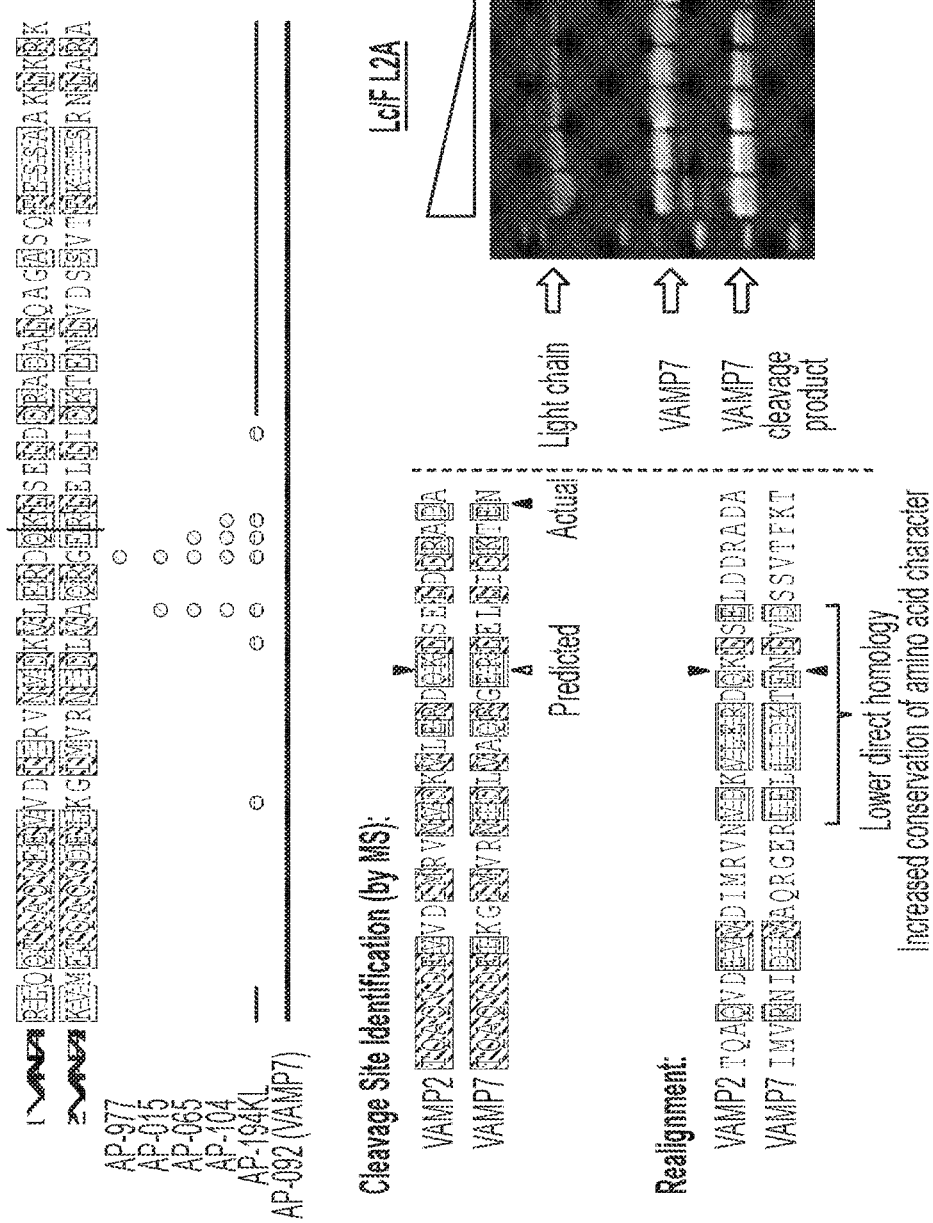
FIG. 40 shows data indicating that the cleavage site of BoNT F variant 2020-L2A protease in VAMP7 has shifted relative to the predicted cleavage site, as measured by MS. SEQ ID NOs: 396-401 (top and bottom) are shown.

In vitro activity of BoNT F variant 2020-L2A was tested using a VAMP7 cleavage assay. FIG. 39 shows data indicating that BoNT F variant 2020-L2A protease is active in vitro. FIG. 40 shows data indicating that the cleavage site of BoNT F variant 2020-L2A protease in VAMP7 has shifted relative to the predicted cleavage site, as measured by MS.

Figure 41:
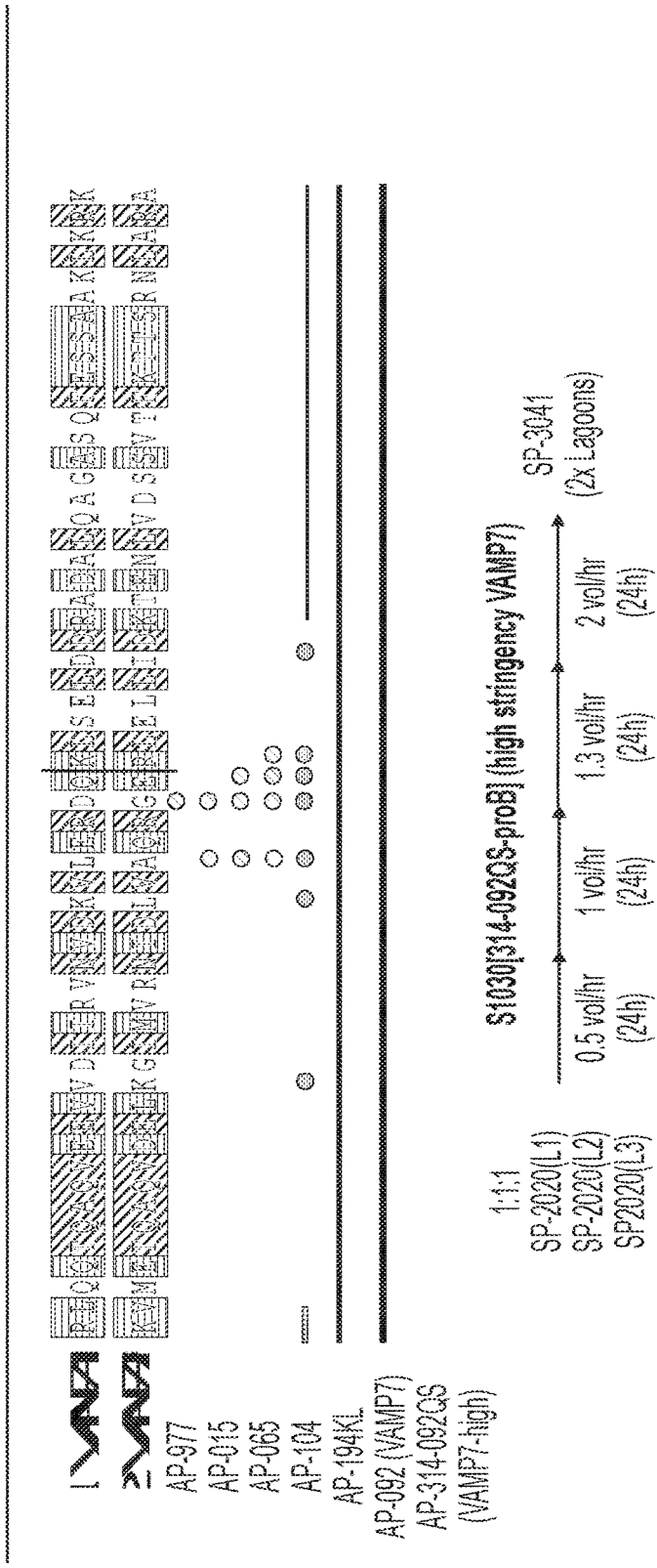
FIG. 41 shows results of a high-stringency PACE experiment to improve VAMP7 cleavage activity of BoNT F protease variants (PACE-3401). Sequences for VAMP2 (SEQ ID NO: 396) and VAMP7 (SEQ ID NO: 397) are shown.

PACE experiments using high stringency positive selection were performed in order to improve activity of evolved BoNT F proteases. FIG. 41 shows the selection strategy used during PACE-3401. Table 29 describes mutations present in clones isolated from PACE-3401.

TABLE 29

| | | K31N | Y72H | N99S | V106A | S141T |
|---|---|---|---|---|---|---|
| L1 | a | | | | V106A | |
| | b | | Y72H | | V106A | S141T |
| | c | | Y72H | | V106A | S141T |
| | d | | Y72H | | V106A | S141T |
| | e | K31N | Y72H | N99S | V106A | |
| | f | | | | V106A | |

TABLE 29-continued

| | | | | | | | | | |
|---|---|---|---|---|---|---|---|---|---|
| g | | | | V106A | | | | |
| h | | N99S | | V106A | | | | |
| L2 a | Y72H | | | V106A | Y113C | V131G | S141T | |
| b | | | | V106A | | | | |
| c | | | | V106A | | | | |
| d | K29E | | | V106A | | | | I150T |
| e | | N99S | N101D | V106A | | | | I150T |
| f | Y72H | | | V106A | | V131G | S141T | |
| g | | | | V106A | | | | |
| h | Y72H | | | V106A | | V131G | | |

| | | | | | | | | |
|---|---|---|---|---|---|---|---|---|
| L1 a | | S166Y | S167I | | | | | E200G |
| b | | S166Y | S167I | | | N184T | | E200G |
| c | | S166Y | S167I | | | | | E200G |
| d | | S166Y | S167I | | | N184T | | E200G |
| e | | S166Y | S167I | | G178A | | | E200G |
| f | | S166Y | S167I | | | | V193M | E200G |
| g | | S166Y | | | | N184K | | E200G |
| h | | S166Y | S167I | | | | | E200G |
| L2 a | | S166Y | S167I | | | | | E200G |
| b | | S166Y | S167I | | | | V193M | E200G |
| c | | S166Y | S167I | | | | | E200G |
| d | | S166Y | S167I | M174T | | | | E200G |
| e | | S166Y | S167I | | G177A | | | E200G |
| f | | S166Y | S167I | M174T | | | | E200G |
| g | V155I | S166Y | S167I | M174T | | | | E200G |
| h | | S166Y | S167I | | | | V193M | E200G |

| | | | | | | | | | | |
|---|---|---|---|---|---|---|---|---|---|---|
| | | | S224I | R240L | | | | | | |
| Y210H | | | S224I | R240L | | | | | | |
| | | | S224I | R240L | | | | | | |
| | | E215G | S224I | R240L | | | | | | |
| | T214I | | S224I | R240L | | | | | | |
| | | | S224I | R240L | | | | | | |
| | | | S224V | R240F | | | | I297L | | T335S |
| | | E215G | S224I | R240L | F267I | F270V | | | | |
| | | | S224I | R240L | | | | | | |
| | | | S224I | R240L | | | | | | |
| | | | S224I | R240L | | | | | R303C | |
| | | | S224I | R240L | | F270V | N293D | | | |
| | | | S224I | R240L | | | | | | |
| | | | S224I | R240L | | | | | | |
| | | | S224I | R240L | | | | | | |

| | | | | | | | | |
|---|---|---|---|---|---|---|---|---|
| | F360L | Y372H | N396H | P410L | | 420(AWLRKS*) | | |
| S350G | F360L | Y372H | N396H | P410L | | 420(AWLRKS*) | | |
| S350G | F360L | Y372H | N396H | P410L | | 420(AWLRKS*) | | |
| S350G | F360L | Y372H | N396H | P410L | | 420(AWLRKS*) | | |
| S350G | F360L | Y372H | N396H | P410L | | 420(AWLRKS*) | | |
| S350G | F360L | Y372H | N396H | P410L | | 420(AWLRKS*) | | |
| | F360L | Y372H | N396H | P410L | D418Y | F420S | | E423K |
| | F360L | Y372H | N396H | P410L | D418Y | | | E423K |
| S350G | F360L | Y372H | N396H | P410L | | 20(AWLRKSRSSNNGDFQHGLAQP*) | | |
| S350G | F360L | Y372H | N396H | P410L | | 420(AWLRKS*) | | |
| S350G | F360L | Y372H | N396H | P410L | | 420(AWLRKS*) | | |
| S350G | F360L | Y372H | N396H | P410L | | 420(AWLRKS*) | | |
| S350G | F360L | Y372H | N396H | P410L | | 420(AWLRKS*) | | |
| S350G | F360L | Y372H | N396H | P410L | | 420(AWLRKS*) | | |
| S350G | F360L | Y372H | N396H | P410L | | 420(AWLRKS*) | | |
| S350G | F360L | Y372H | N396H | P410L | | 420(AWLRKS*) | | |

Figure 42:
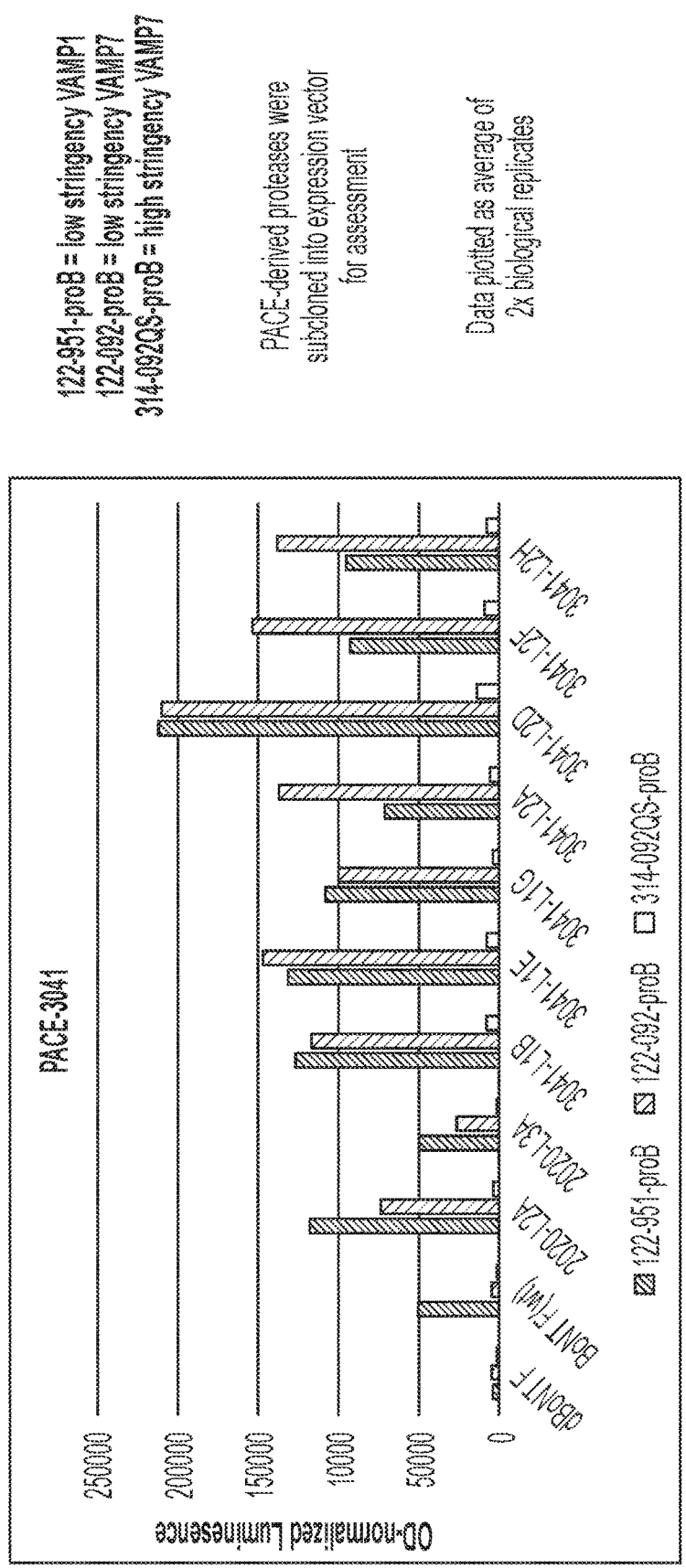
FIG. 42 shows luciferase assay data comparing 2020-L2A and 2020-L3A BoNT F protease-containing phage to PACE-3041 clones. 122-951-proB=low stringency VAMP1; 122-092-proB-low stringency VAMP7; 314-092QS-proB=high stringency VAMP7.

Luciferase assays were performed to investigate the activity of PACE-3041 BoNT F variants. It was observed that PACE-3041 protease variants have improved apparent activity relative to the parental PACE-2020 protease variants from which they were evolved. For example, FIG. 42 shows luciferase assay data comparing 2020-L2A and 2020-L3A BoNT F protease-containing phage to PACE-3041 clones.

Figure 43:
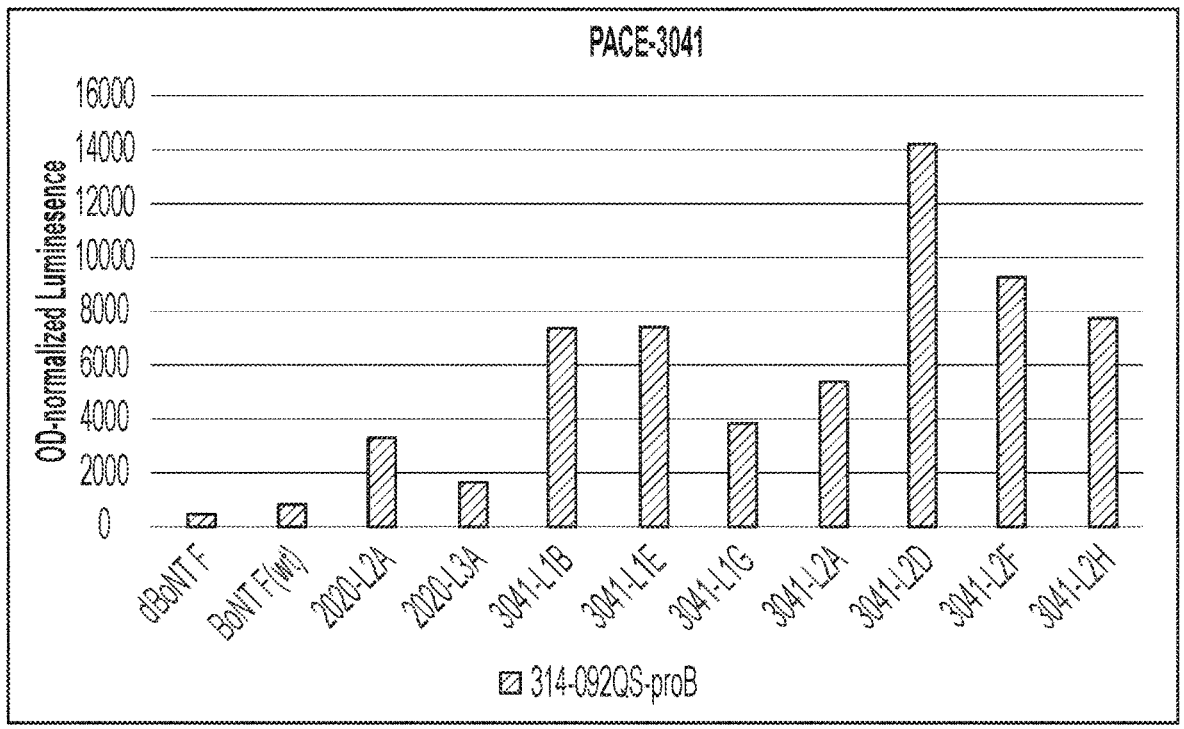
FIG. 43 shows luciferase assay data comparing 2020-L2A and 2020-L3A BoNT F protease-containing phage to PACE-3041 clones isolated from 314-092QS-proB lagoons.

FIG. 43 shows luciferase assay data comparing 2020-L2A and 2020-L3A BoNT F protease-containing phage to PACE-3041 clones isolated from 314-092QS-proB lagoons.

Figure 44:
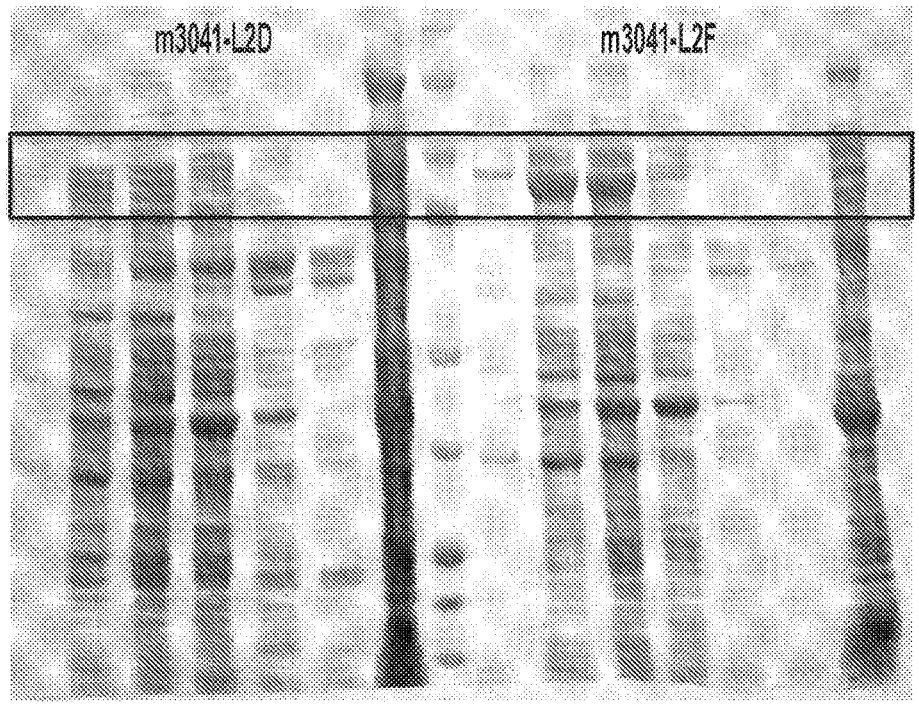
FIG. 44 shows data relating to in vitro characterization of BoNT F protease variants (m3041-L2D and m3041-L2F).
Figures 45, 46:
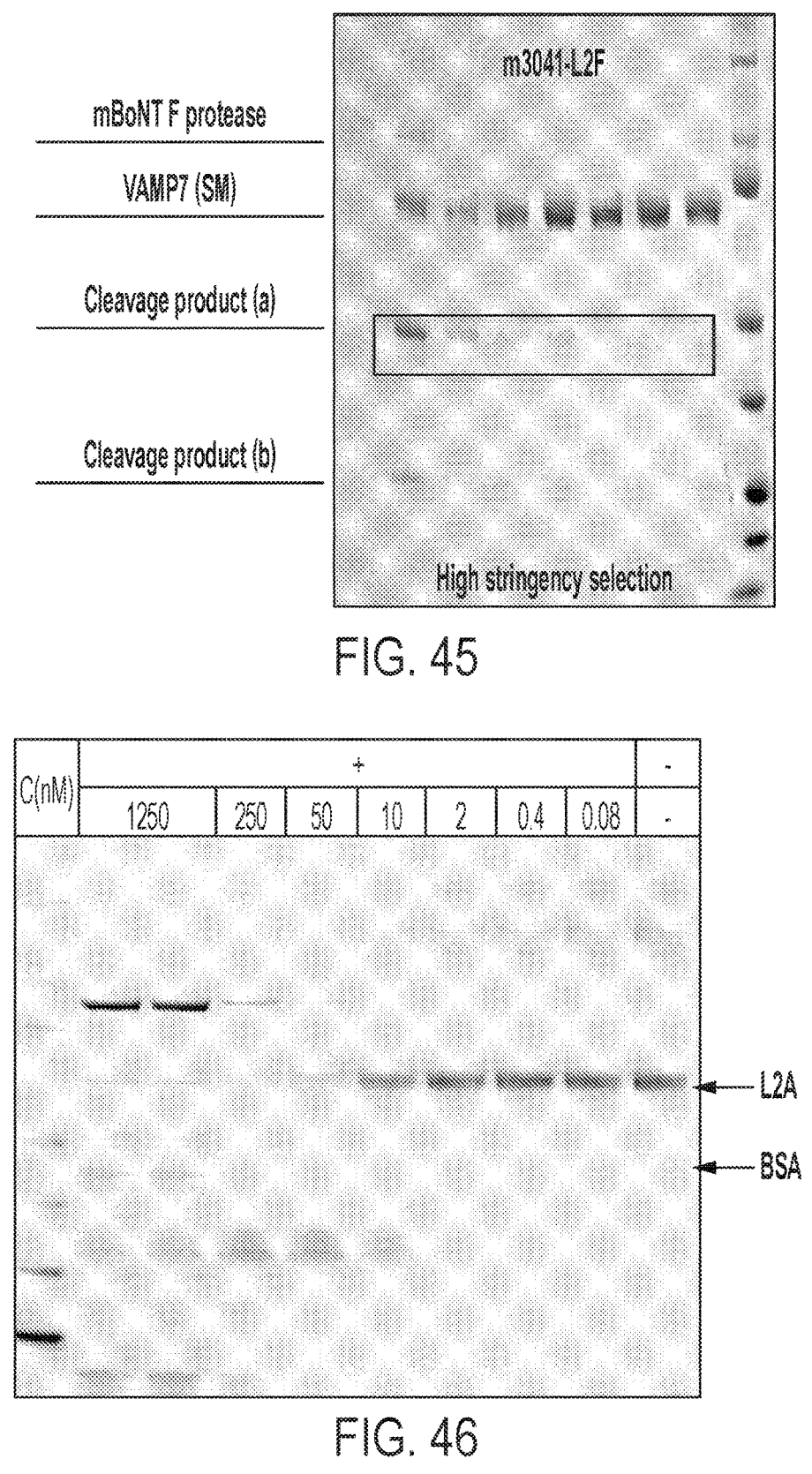
Figure 47:
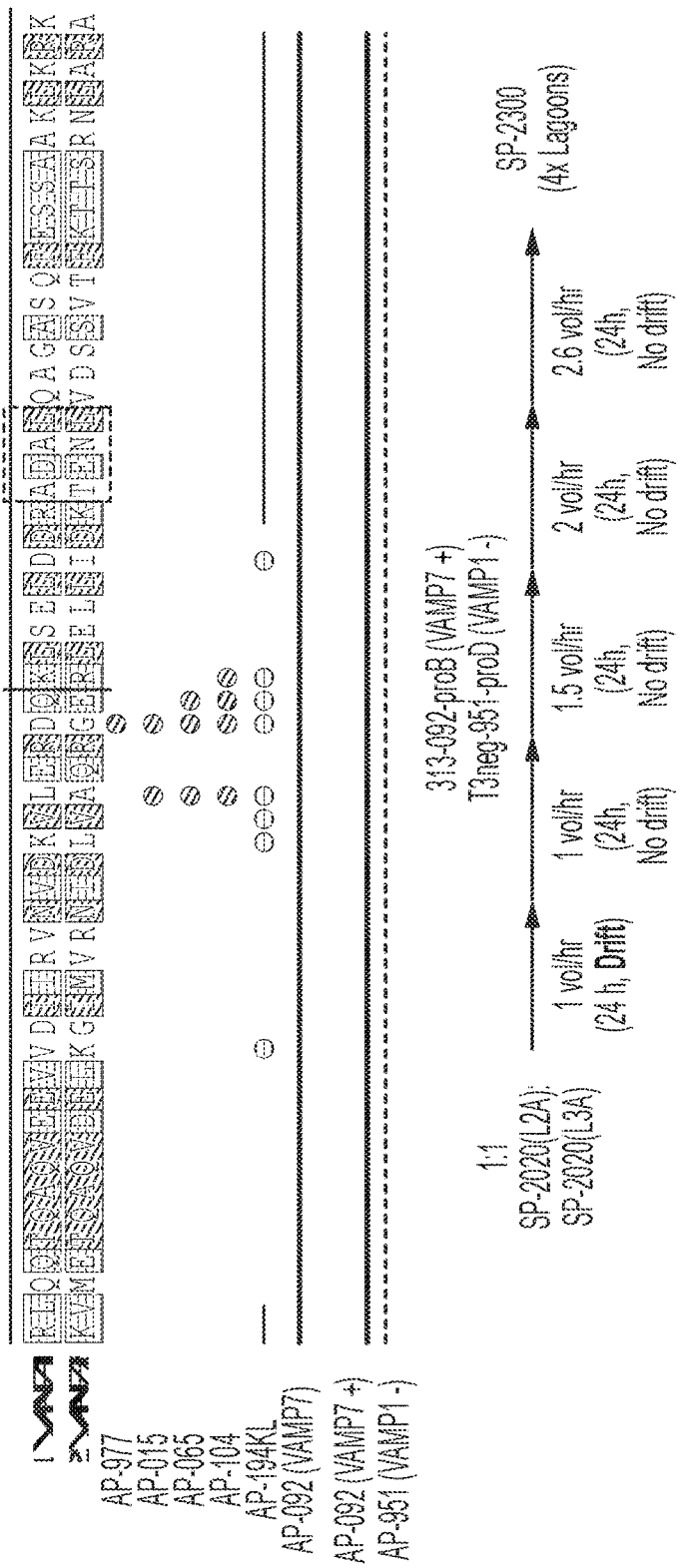
FIG. 47 shows data relating to PACE experiment PACE-2300 (VAMP7 positive selection, VAMP1 negative selection). 313-092-proB (VAMP7+)=positive selection on VAMP7 substrate; T3neg-951-proD (VAMP1−)=simultaneous negative selection on VAMP1 substrate. VAMP2 (SEQ ID NO: 396) and VAMP7 (SEQ ID NO: 397) are shown.

It was observed that BoNT F PACE-3041 variants were difficult to express and isolated; however, two clones, 3041-L2F and 3041-L2D were successfully isolated and recombinantly expressed. See, FIG. 44. In vitro validation of m3041-L2F was subsequently performed. FIG. 45 shows data indicating that m3041-L2F retained catalytic activity in vitro.

Selectivity of BoNT F 2020 protease variants was also tested. See, FIG. 46. Data indicated that off-target cleavage was observed for BoNT F 2020-L2A samples.

In order to improve selectivity of BoNT F protease variants, a dual-selection approach was used. Briefly, positive selection for VAMP7 cleavage was combined with negative selection for VAMP1 cleavage (referred to as PACE-2300). Genotypes of BoNT F protease variants isolated from PACE-2300 are shown in Table 29.

TABLE 30

| Row | Mutations |
|---|---|
| L1 a | N6S, I52V, V106A |
| b | N6S, D58Y, E60D, S70H, V106A |
| c | N6S, A63V, A63V, V106A |
| d | N6S, I52V, V106A |
| e | N6S, A63V, A63V, V106A |
| f | N6S, A63V, A63V, V106A |
| g | N6S, A63V, A63V, V106A |
| h | N6S, D58Y, E60D, S70H, T90I, V106A |
| L2 a | V106A |
| b | Y10C, R49L |
| c | V106A |
| d | V106A |
| e | V106A, T132I |
| f | V106A |
| g | V106A, T132I |
| h | V106A, T132I |
| L3 a | V106A |
| b | V106A |
| c | D16N, V106A |
| d | G53S, V106A |
| e | V106A |
| f | V106A |
| g | V106A |
| h | V106A |
| L4 a | V106A |
| b | V106A |
| c | V106A |
| d | V106A |
| e | E66K, V106A |
| f | V106A |
| g | V106A |
| h | V106A |

| Row | Mutations |
|---|---|
| L1 a | S166Y, S167I, E200G, N211S, S224I |
| b | S166Y, S167I, E200G, S224I |
| c | S166Y, S167I, E200G, S224I |
| d | S166Y, S167I, E200G, N211S, S224I |
| e | S166Y, S167I, E200G, S224I |
| f | S166Y, S167I, E200G, S224I |
| g | S166Y, S167I, E200G, S224I |
| h | S166Y, S167I, E200G, S224I |
| L2 a | S166Y, S167I, E200G, S224I |
| b | S166Y, N184K, E200G, S224I, A226S |
| c | S166Y, S167I, E200G, S224I |
| d | D161G, S166Y, S167I, E200G, S224I |
| e | S166Y, S167I, E200G, S224I |
| f | S166Y, S167I, E200G, F217L, S224I |
| g | S166Y, S167I, E200G, S224I, A232T |
| h | S166Y, S167I, E200G, S224I |
| L3 a | G159S, S166Y, S167I, E200G, S224I |
| b | S166Y, S167I, E200G, S224I |
| c | T123M, S166Y, S167I, E200G, S224I |
| d | V145I, S166Y, S167I, E200G, S224I |
| e | S166Y, S167I, E200G, S224I, A226S |
| f | S166Y, S167I, E200G, S224I |
| g | S166Y, S167I, E200G, S224I, A232T |
| h | S166Y, S167I, E200G, Y201H, S224I |
| L4 a | S166Y, S167I, E200G, S224I |
| b | S166Y, S167I, E200G, S224I |
| c | S166Y, S167I, E200G, S224I |
| d | S166Y, S167I, E200G, S224I |
| e | T123S, S166Y, S167I, E200G, S224I, A226S |
| f | S166Y, S167I, E200G, S224I |
| g | S166Y, S167I, E200G, S224I, A232T |
| h | S166Y, S167I, E200G, Y201H, S224I |

| Mutations |
|---|
| R240L, N314S, S350G, F360L |
| R240L, N339S, S350G, F360I |
| R240L, S350G, F360L |
| R240L, N314S, S350G, F360L |
| R240L, S350G, F360L |
| R240L, S350G, F360L |
| R240L, S350G, F360L |
| R240L, T335I, N339S, S350G, F360L |
| R240L, S350G, F360L |
| R240F, T335S, F360L |
| R240L, S350G, F360L |
| R240L, G325S, S350G, F360L |
| R240L, S350G, F360L |
| R240L, I262T, S350G, F360L |

TABLE 30-continued

| | | | | | | | |
|---|---|---|---|---|---|---|---|
| R240L | | | | | | S350G | F360L |
| R240L | | | | | | S350G | F360L |
| R240L | | | | | | S350G | F360L |
| R240L | | | S333F | | | S350G | F360L |
| R240L | | | | | | S350G | F360L |
| R240L | | | | | | S350G | F360L |
| R240F | | | S333F | | | S350G | F360L |
| R240L | | | S333F | | | S350G | F360L |
| R240L | | | S333F | | | S350G | F360L |
| R240L | | | S333F | | | S350G | F360L |
| R240L | | D274M | | D331G | | S350G | F360L |
| R240L | L264M | | | | | S350G | F360L |
| R240L | L264M | | | | | S350G | F360L |
| R240L | L264M | | | | | S350G | F360L |
| R240F | | | | | | S350G | F360L |
| R240L | L264M | | | | | S350G | F360L |
| R240L | L264M | | | | | S350G | F360L |
| R240L | L264M | | | | | S350G | F360L |

| | | | | | | | |
|---|---|---|---|---|---|---|---|
| | | Y372H | | N396H | | P410L | 420(AWLRKS*) | |
| | | Y372H | | N396H | | P410L | 420(AWLRKS*) | |
| | | Y372H | | N396H | | P410L | 420(AWLRKS*) | |
| | | Y372H | | N396H | | P410L | 420(AWLRKS*) | |
| | | Y372H | | N396H | | P410L | 420(AWLRKS*) | |
| | | Y372H | | N396H | | P410L | 420(AWLRKS*) | |
| | | Y372H | | N396H | | P410L | 420(AWLRKS*) | |
| T367S | | Y372H | | N396H | | P410L | 420(AWLRKS*) | |
| T367S | | Y372H | | N396Y | | P410L | 420(AWLRKS*) | |
| | F369F | Y372H | | N396H | | P410L | D418Y | E423K |
| | | Y372H | | N396H | | P410L | 420(DWLRKS*) | |
| | | Y372H | V377I | N396H | | P410L | 420(AWLRKS*) | |
| | | Y372H | | N396H | | P410L | 420(AWLRKS*) | |
| | | Y372H | V377I | N396H | | P410L | 420(AWLRKS*) | |
| | | Y372H | V377I | N396H | | P410L | 420(DWLRKS*) | |
| T367S | | Y372H | | N396H | | P410L | 420(AWLRKS*) | |
| | F369F | Y372H | | N396H | N409D | P410L | 420(AWLRKS*) | |
| | | Y372H | | N396H | | P410L | 420(AWLRKS*) | |
| | | Y372H | | N396H | | P410L | 420(AWLRKS*) | |
| | | Y372H | | N396H | N409D | P410L | 420(AWLRKS*) | |
| | | Y372H | | N396H | N409D | P410L | 420(AWLRKS*) | |
| | | Y372H | | N396H | N409D | P410L | 420(DWLRKS*) | |
| T367S | | Y372H | | N396H | | P410L | 420(AWLRKS*) | |
| | F369F | Y372H | | N396H | | P410L | 420(AWLRKS*) | |
| | | Y372H | | N396H | | P410L | 420(AWLRKS*) | |
| | | Y372H | | N396H | | P410L | 420(AWLRKS*) | |
| | | Y372H | N379H | N396H | | P410L | 420(AWLRKS*) | |
| | | Y372H | | N396H | | P410L | 420(AWLRKS*) | |
| | | Y372H | | N396H | | P410L | 420(AWLRKS*) | |
| | | Y372H | | N396H | | P410L | 420(DWLRKS*) | |

Figure 48:
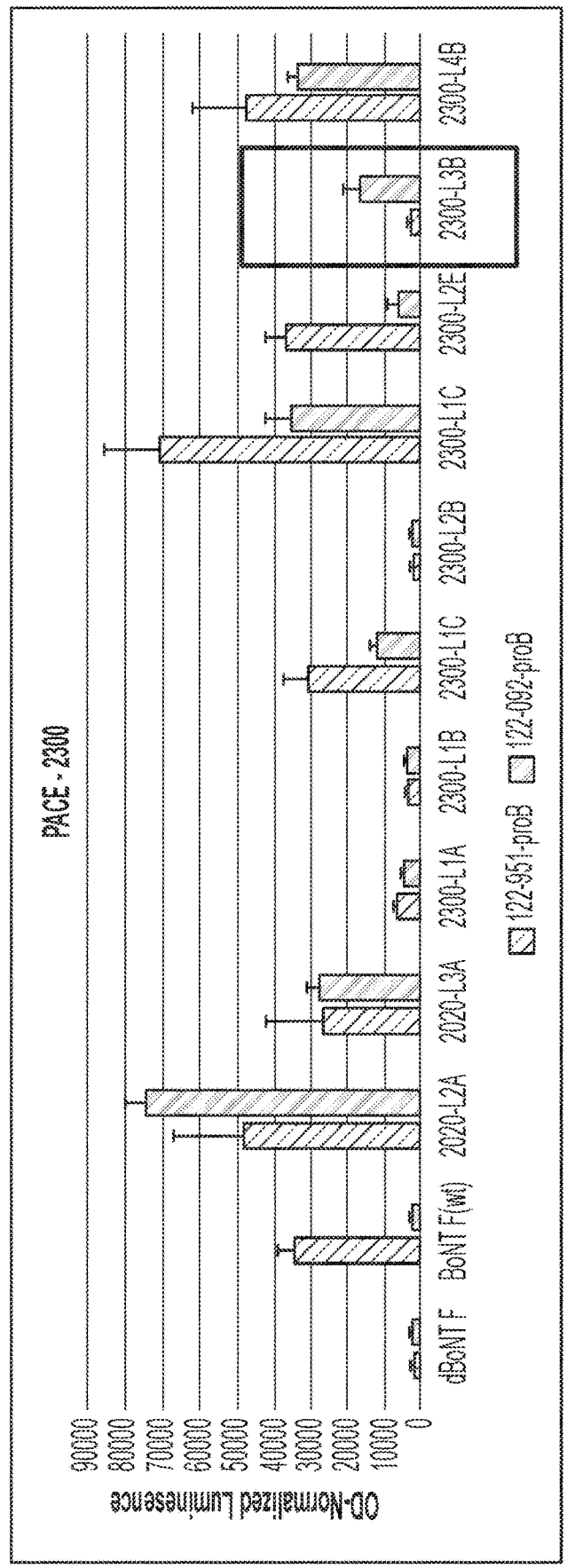
FIG. 48 shows luciferase assay data relating to PACE experiment PACE-2300. one clone that possesses apparent selectivity: BoNT F(2300-L3B).
Figure 49:
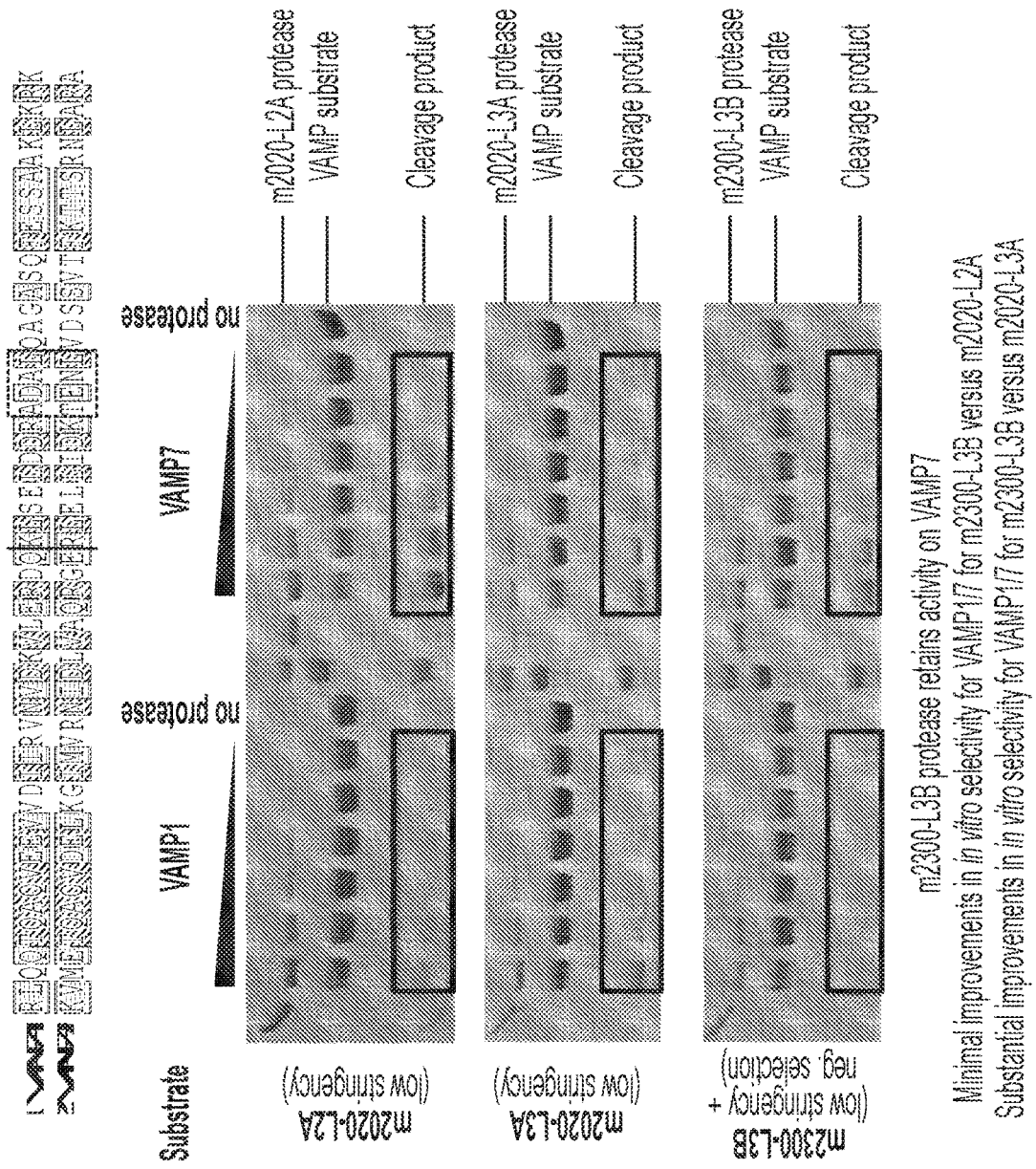
FIG. 49 shows data relating to the in vitro characterization of m2300-L3B. m2300-L3B protease retains activity on VAMP7. Improvements in in vitro selectivity for VAMPI/7 for m2300-L3B versus m2020-L2A were observed. Substantial improvements in in vitro selectivity for VAMPI/7 for m2300-L3B versus m2020-L3A were observed. SEQ ID NOs: 396 and 397 are shown from top to bottom.

A single clone with apparent activity was isolated from PACE-2300, which was cloned and recombinantly expressed. Luciferase assay data indicated that BoNT F 2300-L3B is active in vitro (FIG. 48). Further in vitro characterization experiments were performed. FIG. 49 shows data relating to the in vitro characterization of m2300-L3B. m2300-L3B protease retains activity on VAMP7. Improvements in in vitro selectivity for VAMP1/7 for m2300-L3B versus m2020-L2A were observed. Substantial improvements in in vitro selectivity for VAMP1/7 for m2300-L3B versus m2020-L3A were observed.

SEQUENCE LISTING (401 sequences)

SEQ ID NO: 1 - protein, 411 aa, Artificial Sequence
  Synthetic polypeptide
MPKINSFNYNDPVNDRTILYIKPGGCKEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAHGITTTCSITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 2 - protein, 411 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGALGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYTGQYKYFKLSNLLNDSIYNISEGYNINNLKVNFRGQNANLNPRIIKPITGRGLVKKIIRF

SEQ ID NO: 3 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGALGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 4 - protein, 411 aa, Artificial Sequence
  Synthetic polypeptide
MPKINSFNYNDPVNDRTILYIKPGGCKEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 5 - protein, 411 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAHGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 6 - protein, 411 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 7 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFATHSSNISLRNNYMPSNHGFGSIAIVTFSPEYSFRFNDNSINEFIQDPALTLMHELIHSLHGLYGAKGITTTCSITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 8 - protein, 411 aa, Artificial Sequence
  Synthetic polypeptide
MPKINSFNYNDPVNDRTILYIKPGGCKEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFATHSSNISLRNNYMPSNHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 9 - protein, 411 aa, Artificial Sequence
  Synthetic polypeptide
MPKINSFNYNDPVNDRTILYIKPGGCKEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCSITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 10 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFATNSSNISLRNNYMPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 11 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFLTYSSNISLRNNYMPSNHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 12 - protein, 411 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFSTHSSNISLRNNYMPSNHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 13 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFATYSSNISLRNNYMPSNHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 14 - protein, 410 aa, Artificial Sequence
  Synthetic polypeptide
MPKINSFNYNDPVNDRTILCIKPGGCQKFYKSFNIMKNIWIIPERNVIGTTPQDFHPPTSLKNGDSSYYDPNYLQSDGEKDRFLKIVTKIFNRINNNLSGGILLEELSKANPYLGNDNTPDNQFHIGAQSAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQIKCRETYIGQYKYFKLSNLLNDSIYNISEGYNINNLKVNFRGQNANLNPRIIKPITGRGVKKIIRF

SEQ ID NO: 15 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGGGSAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPSTGRGLVKKIIRF

SEQ ID NO: 16 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGGQSAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 17 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGAQSAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGTTTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 18 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGAQSAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPIAGRGLVKKIIRF

SEQ ID NO: 19 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 20 - protein, 411 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 21 - protein, 411 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNVSLRNNYMPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 22 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGSILLEELSKANPYLGNDNTPDNQFHIGDASAVEIKFSNGSQHILLPNVIIMGAEPDLFETNSSNISLKNNYMPSNHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 23 - protein, 411 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNPSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYLKLSNLLNDSIYNISEGYNINNLKVNFRGQNANLNPRIIKPITGRGLVKKIIRF

SEQ ID NO: 24 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCSITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPIKGRGLVKKIIRF

SEQ ID NO: 25 - protein, 411 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 26 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGSILLEELSKANPYLGNDNTPDNQFHIGDASAVEIKFSNGSQHILLPNVIIMGAEPDLFETNSSNISLKNNYMPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 27 - protein, 411 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGALGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 28 - protein, 411 aa, Artificial Sequence
  Synthetic polypeptide
MPKINSFNYNDPVNDRTILYIKPGGCREFYKSFNIMKNIWIIPERNVIGTTPQDFHPPTSLKNGDSSYYDPNYLQSDEEKDRFLKIVTKIFNRINNNPSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDKSMNEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 29 - protein, 410 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGALGVTTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYTGQYKYFKLSNLLNDSIYNISEGYNINNLKVNFRGQNANLNPRIIKPITGRGVKKIIRF

SEQ ID NO: 30 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNCMPSNHGFGSIAIVTFSPEYSFRFNDNSINEFIQDPALTLMHELIHSLHGLYGSHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 31 - protein, 411 aa, Artificial Sequence
  Synthetic polypeptide
MPKINSFNYNDPVNDRTILYISPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIGTFSPEYSFRFNDNSINEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKCFKLSNLLNDSIYNISEGYNINNLKVNFRGQNANLNPRIIKPITGRGLVKKIIRF

SEQ ID NO: 32 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 33 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGLVKKIIRF

SEQ ID NO: 34 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCTITQQQNPLITNRKGINIEEFLTFGGNDLNIITGAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 35 - protein, 411 aa, Artificial Sequence
  Synthetic polypeptide
MPKINSFNYNDPVNDRTILYIKPGGCQEFYKSFNIMKNIWIIPERNIIGTTPQDFHPPTSLKNGDSSYYDPNYLQSDEEKDRFLKIVTKIFNRINNNPSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNIGEGYNINNLKVNFRGQNANLNPRIIKPITGRGLVKKIIRF

SEQ ID NO: 36 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINKLKVNFRGQNANLNPRIIKPITGRGLVKKIIRF

SEQ ID NO: 37 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDKSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDAAGIYSVNINKFDDILKKLYSFTEFDLATKFQVKCRETYIGRHKYFKLSNLLNDSIYNISEGYNINNLKVNFRGQNANLNPRIIKPITGRGLVKKIIRF

SEQ ID NO: 38 - protein, 411 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFSTHSSNISLRNNYSPSNHGFGSIAIVTFSPEYSFRFNDNSINEFIQDPALTLMHELIHSLHGLYGAHGITTTGIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 39 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFSTWSSNISLRNNYMPSNHGFGSIAIVTFSPEYSFRFNDNSINEFIQDPALTLMHELIHSLHGLYGALGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYTGQYKYFKLSNLLNDSIYNISEGYNINNLKVNFRGQNANLNPRIIKPITGRGLVKKILRF

SEQ ID NO: 40 - protein, 411 aa, Artificial Sequence
  Synthetic polypeptide
MPKINSFNYNDPVNDRTILYIKPGGCREFYKSFNIMKNIWIIPERNVIGTTPQDFHPPTSLKNGDSSYYDPNYLQSDEEKDRFLKIVTKIFNRINNNPSGGILLEELSKANPYLGNDNTPDNQFHIGDASAVEIKFSNGSQHILLPNVIIMGAEPDLFWTWSSNISLRNNYMPSNHGFGSIAIVTFSPEYSFRFNDNSINEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 41 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFQTYSSNISLRNNYMPSNHGFGSIAIVTFSPEYSFRFNDNSINEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 42 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFATWSSNISLRNNYVPSNHGFGSIAIVTFSPEYSFRFNDNSINEFIQDPALTLMHELIHSLHGLYGALGITTTRIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 43 - protein, 411 aa, Artificial Sequence
  Synthetic polypeptide
MPKINSFNYNDPVNDRTILYIKPGGCREFYKSFNIMKNIWIIPERNVIGTTPQDFHPPTSLKNGDSSYYDPNYLQSDEEKDRFLKIVTKIFNRINNNPSGGILLEELSKANPYLGNDNTPDNQFHIGDASAVEIKFSNGSQHILLPNVIIMGAEPDLFATVSSNISLRNNYMPSNHGFGSIAIVTFSPEYSFRFNDNSINEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 44 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNPSGGILLEELSKANPYLGNDNTPDNQFHIGDASAVEIKFSNGSQHILLPNVIIMGAEPDLFCTWSSNISLRNNYMPSNHGFGSIAIVTFSPEYSFRFNDNSINEFIQDPALTLMHELIHSLHGLYGALGITTTRIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 45 - protein, 411 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGALGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 46 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGALGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 47 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFATHSSNISLRNNYMPSNHGFGSIAIVTFSPEYSFRFNDNSINEFIQDPALTLMHELIHSLHGLYGAYGITTTCTITQQQNPLISNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 48 - protein, 411 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNGINEFIQDPALTLMHELIHSLHGLYGALGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 49 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFATHSSNISLRNNYMPSNHGFGSIAIVTFSPEYSFRFNDNSINEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 50 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNGIIMGAEPDLFETNSSNISLRNNYMPSNHGFGSIAIVTFSPEYSFRFNDNSINEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKHFKLSNLLNDSIYNISEGYNINNLKVNFRGQNANLNPRIIKPITGRGLVKKIIRF

SEQ ID NO: 51 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNGIIMGAEPDLFETNSSNISLRNNYMPSNHGFGSIAIVTFSPEYSFRFNDNSINEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKCFKLSNLLNDSIYNISEGYNINNLKVNFRGQNANLNPRIIKPITGRGLVKKIIRF

SEQ ID NO: 52 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNGIIMGAEPDLFETNSSNISLRNNYMPSNHGFGSIAIVTLSPEYSFRFNDNSINEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKCFKLSNLLNDSIYNISEGYNINNLKVNFRGQNANLNPRIIKPITGRGLVKKIIRF

SEQ ID NO: 53 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNGIIMGAEPDLFETNSSNISLRNNCMPSNHGFGSIAIVTFSPEYSFRFNDNSINEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 54 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSRHILLPNVIIMGAEPDLFAAHSSNISLRNNYMPANHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGLVKKIIRF

SEQ ID NO: 55 - protein, 410 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFAAHSSNISLRNNYMPANHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGVKKIIRF

SEQ ID NO: 56 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFAAHSSNISLRNNYMPANHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGLVKKIIRF

SEQ ID NO: 57 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFAAHSSNISLRNNYMPANHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKNASGIYSVNINKFDDILKKLYSFTEFDLATKFQVKCRETYIGRHKYFKLSNLLNDSIYNISEGYNINNLKVNFRGQNTNLNPRIIKPITGRGLVKKIIRF

SEQ ID NO: 58 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFCSWSSNISLRNNYMPSNHGFGSIAIVTFSPEYSFRFNDNSINEFIQDPALTLMHELIHSLHGLYGALGITTTRIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKSFKLSNLLNDSIYNISEGYNINNLKVNFRGQNANLNPRIIKPITGRGLVKKIIRF

SEQ ID NO: 59 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFCTWSSNISLRNNYRPSNHGFGSIAIVTFSPEYSFRFNDNSINEFIQDPALTLMHELIHSLHGLYGALGITTTRIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKCFKLSNLLNDSIYNISEGYNINNLKVNFRGQNANLNPRIIKPITGRGLVKKIIRF

SEQ ID NO: 60 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFRTYSSNISLRNNYMPSNHGFGSIAIVTFSPEYSFRFNDKSMNEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDEDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 61 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFCSWSSNISLRNNYMPSNHGFGSIAIVTFSPEYSFRFNDNSINEFIQDPALTLMHELIHSLHGLYGALGITTTRIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKCFKLSNLLNDSIYNISEGYNINNLKVNFRGQNANLNPRIIKPITGRGLVKKIIRF

SEQ ID NO: 62 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFCTWSSNISLRNNYMPSNHGFGSIAIVTFSPEYSFRFNDNSINEFIQDPALTLMHELIHSLHGLYGALGITTTRIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKCFKLSNLLNDSIYNISEGYNINNLKVNFRGQNANLNPRIIKPITGRGLVKKIIRF

SEQ ID NO: 63 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFCSWSSNISLRNNYMPSNHGFGSIAIVTFSPEYSFRFNDNSINEFIQDPALTLMHELIHSLHGLYGALGITTTRIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 64 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFSTWSSNISLRNNYMPSNHGFGSIAIVTFSPEYSFRFNDKSMNEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 65 - protein, 411 aa, Artificial Sequence; identical to SEQ ID NO: 46
  Synthetic polypeptide

SEQ ID NO: 66 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGALGITTTCTITQQQNPLITNRKGINIEEFLTFGGNDLNIITVTQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 67 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSDGSQHILLPNVIIMGAEPDLFETNSSNISLRNNYMPSNHGFGSIAIVTFSPEYSFRFNDNSINEFIQDPALTLMHELIHSLHGLYGALGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILNKLYSFTEFDLATKFQVKCRETYIGQYKYFKLSNLLNDSIYNISEGYNINNLKVNFRGQNANLNPRIIKPITGRGLVKKIIRF

SEQ ID NO: 68 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFRNGSQHILLPNVIIMGAEPDLFETNSSNISLRNNYMPSNHGFGSIAIVTFSPEYSFRFNDNSINEFIQDPALTLMHELIHSLHGLYGALGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 69 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAGPDLFEANSSNISLRNNYMPSNHGFGSIAIVTFSPEYSFRFNDNSINEFIQDPALTLMHELIHSLHGLYGAHGITTTRIITQQQNPLITNRKGINIEEFLTFGGNDLNIVTVAQYNDIYTNLLNDYRKIASKLSKVQVSNPQLNPYKDIFQEKYGLDKDASGIYSVNINKFDDILKKLYSFTEFDLATKFQVKCRETYIGQYKCFKLSNLLNDSIYNISEGYNINNLKVNFRGQNANLNPRIIKPITGRGLVKKIIRF

SEQ ID NO: 70 - protein, 411 aa, Artificial Sequence
  Synthetic polypeptide
MPKINSFNYNDPVNDRTILYIRPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAGPDLFETNSRNISLRNNYMPSNHGFGSIAIVTFSPEYSFRFNDNSINEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYAGQYKCFKLSNLLNDSIYNISEGYNINNLKVNFRGQNANLNPRIIKPITGRGLVKKIIRF

SEQ ID NO: 71 - protein, 411 aa, Artificial Sequence
  Synthetic polypeptide
MPKINSFNYNDPVNDRTILYIRPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAGPDLFETNSRNISLRNNYMPSNHGFGSIAIVTFSPEYSFRFNDNSINEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYAGQYKWFKLSNLLNDSIYNISEGYNINNLKVNFRGQNANLNPRIIKPITGRGLVKKIIRF

SEQ ID NO: 72 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAGPDLFEANSSNISLRNNYMPSNHGFGSIAIVTFSPEYSFRFNDNSINEFIQDPALTLMHELIHSLHGLYGAHGITTTRIITQQQNPLITNRKGINIEEFLTFGGNDLNIVTVAQYNDIYTNLLNDYRKIASKLSKVQVSNPQLNPYKDIFQEKYGLDKDASGIYSVNINKFDDILKKLYSFTEFDLATKFQVKCRETYIGQYKCFKLSNLLNDSIYNISEGYNINNLKVNFRGQNANLNPRIIKPSTGRGLVKKIIRF

SEQ ID NO: 73 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAGPDLFETNASNISLRNNYRPSNHGFGSIAIVTFSPEYSFRFNDNSINEFIQDPALTLMHELIHSLHGLYGAHGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKYFKLSNLLNDSIYNISEGYNINNLKVNFRGQNANLNPRIIKPITGRGLVKKIIRF

SEQ ID NO: 74 - protein, 410 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFAAHSSNISLRNNYMPANHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGVKKIIRF

SEQ ID NO: 75 - protein, 410 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGGASAVEIKFSNGSQHILLPNVIIMGAEPDLFAAHSSNISLRNNYMPANHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGVKKIIRF

SEQ ID NO: 76 - protein, 410 aa, Artificial Sequence
  Synthetic polypeptide
MPKINSFNYNDPVNDRTILYMKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFAAHSSNISLRNNYMPANHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGVKKIIRF

SEQ ID NO: 77 - protein, 411 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFAAHSRNISLRNNYMPANHGFGSIAIVTFSPEYSFRFNDNSINEFIQDPALTLMHELIHSLHGLYGAKGITTTCIITQQQNPLITNRRGINIEEFLTFGGNDLNIITGAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGLVKKIIRF

SEQ ID NO: 78 - protein, 411 aa, Artificial Sequence
  Synthetic polypeptide
MPKINSFNYNDPVNDRTILYIKPGGCHEFYKSFNIMKNIWIIPERNVIGTTPQDFHPPTSLKNGDSSYYDPNYLQSDEEKDRFLKIVTKIFNRINNNLAGSILLEELSKANPYLGNDNTPDNQFHIGDASAVEIKFSNGSQHILLPNVIIMGAEPDLFLTYQSNISLRNNYMPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGLVKKIIRF

SEQ ID NO: 79 - protein, 410 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNKPDNQFHIGDASAVEIKFSNGSQHILLPNVIIMGAEPDLFAAHSSNISLRNNYMPANHGFGSIAIVTFSPEYSFRFNDNSINEFIQDPALTLMHELIHSLHGLYGAKGITTTCIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGVKKIIRF

SEQ ID NO: 80 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFCTWSSNISLRNNYMPSNHGFGSIAIVTFSPEYSFRFNDNSINEFIQDPALTLMHELIHSLHGLYGALGITTTRIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGLVKKIIRF

SEQ ID NO: 81 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFCSWSSNISLRNNYMPSNHGFGSIAIVTFSPEYSFRFNDNSMNEFIQDPALTLMHELIHSLHGLYGALGITTTRIITQQQNPLITNRKGINIEEFLTFGGNDLNIITGAQYNDIYTNLLNDYRKIASKLSKVQVSNPQLNPYKDIFQEKYGLDKDASGIYSVNINKFDDILKKLYSFTEFDLATKFQVKCRETYIGRYKCFKLSNLLNDSIYNISEGYNINNLKVNFRGQNANLNPRIIKPITGRGLVKKIIRF

SEQ ID NO: 82 - protein, 411 aa, Artificial Sequence; identical to SEQ ID NO: 61
  Synthetic polypeptide

SEQ ID NO: 83 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFCTWSSNISLRNNYMPSNHGFGSIAIVTFSPEYSFRFNDNSINEFIQDPALTLMHELIHSLHGLYGSLGITTTRIITQQQNPLITNRRGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGLVKKIIRF

SEQ ID NO: 84 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFCSWSSNISLRNNYMPSNHGFGSIAIVTFSPEYSFRFNDNSMNEFIQDPALTLMHELIHSLHGLYGALGITTTRIITQQQNPLITNRKGINIEEFLTFGGNDLNIITGAQYNDIYTNLLNDYRKIASKLSKVQVSNPQLNPYKDIFQEKYGLDKDSSGIYSVNINKFDDILKKLYSFTEFDLATKFQVKCRETYIGRYKCFKLSNLLNDSIYNISEGYNINNLKVNFRGQNANLNPRIIKPITGRGLVKKIIRF

SEQ ID NO: 85 - protein, 410 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFCSWSSNISLRNNYMPSNHGFGSIAIVTFSPEYSFRFNDNSINEFIQDPALTLMHELIHSLHGLYGALGITTTRIITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGQYKCFKLSNLLNDSIYNISEGYNINNLKVNFRGQNANLNPRIIKPITGRGVKKIIRF

SEQ ID NO: 86 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFCTWSSNISLRNNYMPSNHGFGSIAIVTFSPEYSFRFNDNSINEFIQDPALTLMHELIHSLHGLYGALGITTTRIITQQQNPLITNRKGVNIEEFLTFGGNDLNIITGAQYNDIYTNLLNDYRKIASKLSKVQVSNPQLNPYKDIFQEKYGLDKDASGIYSVNINKFDDILKKLYSFTEFDLATKFQVKCRETYVGQYKCFKLSNLLNDSIYNISEGYNINNLKVNFRGQNANLNPRIIKPITGRGLVKKIIRF

SEQ ID NO: 87 - protein, 411 aa, Artificial Sequence
  Synthetic polypeptide
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFCSWSSNISLRNNYMPSNHGFGSIAIVTFSPEYSFRFNDNSMNEFIQDPALTLMHELIHSLHGLYGALGITTTRIITQQQNPLITNRKGINIEEFLTFGGNDLNIITGAQYNDIYTNLLNDYRKIASKLSKVQVSNPQLNPYKDIFQEKYGLDKDASGIYSVNINKFDDILKKLYSFTEFDLATKFQVKCRETYIGQYKCFKLSNLLNDSIYNISEGYNINNLKVNFRGQNANLNPRIIKPITGRGLVKKIIRF

SEQ ID NO: 88 - protein, 411 aa, Artificial Sequence
  Synthetic polypeptide
MPKINSFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGALGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGLVKKIIRF

SEQ ID NO: 89 - protein, 411 aa, Artificial Sequence
  Synthetic polypeptide
MPKINGFNYNDPVNDRTILYIKPGGCQKFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQHILLPNVIIMGAEPDLFETNSSNISLRNNYMPSNHGFGSIAIVTFSPEYSFRFNDNSINEFIQDPALTLMHELIHSLHGLYGALGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGLVKKIIRF

SEQ ID NO: 90 - protein, 411 aa, Artificial Sequence
  Synthetic polypeptide
MPKINSFNYNDPVNDRTILYIKPGGCHEFYKSFNIMKNIWIIPERNVIGTTPQDFHPPTSLKNGDSSYYDPNYLQSDEEKDRFLKIVTKIFNRINNNLAGSILLEELSKANPYLGNDNTPDNQFHIGDASAVEIKFSNGSQHILLPNVIIMGAEPDLFLTYQSNISLRNNYKPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDMFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGLVKKIIRF

SEQ ID NO: 91 - protein, 411 aa, Artificial Sequence
  Synthetic polypeptide
MPKINSFNYNDPVNDRTILYIKPGGCHEFYKSFNIMKNIWIIPERNVIGTTPQDFHPPTSLKNGDSSYYDPNYLQSDEEKDRFLKIVTKIFNRINNNLAGSILLEELSKANPYLGNDNTPDNQFHIGDASAVEIKFSNGSQHILLPNVIIMGAEPDLFLTYQSNISLRNNYKPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGLVKKIIRF

SEQ ID NO: 92 - protein, 411 aa, Artificial Sequence
  Synthetic polypeptide
MPKINSFNYNDPVNDRTILYIKPGGCHEFYKSFNIMKNIWIIPERNVIGTTPQDFHPPTSLKNGDSSYYDPNYLQSDEEKDRFLKIVTKIFNRINNNLAGSILLEELSKANPYLGNDNTPDNQFHIGDASAGEIKFSNGSQHILLPNVIIMGAEPDLFLTYQSNISLRNNYKPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGLVKKIIRF

SEQ ID NO: 93 - protein, 411 aa, Artificial Sequence
  Synthetic polypeptide
MPKINSFNYNDPVNDRTILYIKPGGCHEFYKSFNIMKNIWIIPERNVIGTTPYDFHPPTSLKNGDSSYYDPNYLQSDEEKDRFLKIVTKIFNRINNNLAGSILLEELSKANPYLGNDNTPDNQFHIGDASAVEIKFSNGSQHILLPNVIIMGAEPDLFLTYQSNISLRNNYMPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRHKYFKLSNLLNDSIYNISEGYNINNLKVNFRGQNANLNPRIIKPITGRGLVKKIIRF

SEQ ID NO: 94 - protein, 411 aa, Artificial Sequence
  Synthetic polypeptide
MPKINSFNYNDPVNDRTILYIKPGGCHEFYKSFNIMKNIWIIPERNVIGTTPQDFHPPTSLKNGDSSYYDPNYLQSDEEKDRFLKIVTKIFNRINNNLAGSILLEELSKANPYLGNDDTPDNQFHIGDASAVEIKFSNGSQHILLPNVIIMGAEPDLFLTYQRNISLRNNYKPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRYKPFKLSNLLNDSIYNISEGYNINNLKVNFRGQNANLNPRIIKPITGRGLVKKIIRF

SEQ ID NO: 95 - protein, 411 aa, Artificial Sequence
  Synthetic polypeptide
MPKINSFNYNDPVNDRTILYIKPGGYHEFYKSFNIMKNIWIIPERNVIGTTPQDFHPPTSLKNGDSSHYDPNYLQSDEEKDRFLKIVTKIFNRINNNLAGSILLEELSKANPYLGNDDTPDNQFHIGDASAVEIKFSNGSQHILLPNVIIMGAEPDLFLTYQRNISLRNNYKPSNHGFGSIAIVTFSPEYSFRFNDNSINEFIQDPALTLMHELIHSLHGLYGAKGITTTCTITQQQSPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRYKHFKLSNLLNDSIYNISEGYNINNLKVNFRGQNANLNPRIIKPITGRGLVKKIIRF

SEQ ID NO: 96 - protein, 411 aa, Artificial Sequence
  Synthetic polypeptide
MPKINSFNYNDPVNDRTILYIKPGGCHEFYKSFNIMKNIWIIPERNVIGTTPQDFHPPTSLKNGDSSYYDPNYLQSDEEKDRFLKIVTKIFNRINNNLAGSILLEELSKANPYLGNDDTPDNQFHIGDASAVEIKFSNGSQHILLPNVIIMGAEPDLFLTYQRNISLRNNYKPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRYKPFKLSNLLNDSIYNISEGYNINNLKVNFRGQNANLNPRIIKPITGRGLVKKITRF

SEQ ID NO: 97 - protein, 410 aa, Artificial Sequence
  Synthetic polypeptide
MPKINSFNYNDPVNDRTILYIKPGGCHEFYKSFNIMKNIWIIPERNVIGTTPQDFHPPTSLKNGDSSYYDPNYLQSDEEKDRFLKIVTKIFNRINNNLTGSILLEELSKANPYLGNDDTPDNQFHIGDASAVEIKFSNGSQHILLPNVIIMGAEPDLFLTYQRNISLRNNYKPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRYKPFKLSNLLNDSIYNISEGYNINNLKVNFRGQNANLNPRIIKPITGRGVKKIIRF

SEQ ID NO: 98 - protein, 411 aa, Artificial Sequence
  Synthetic polypeptide
MPKINSFNYNDPVNDRTILYIKPGGYHEFYKSFNIMKNIWIIPERNVIGTTPQDFHPPTSLKNGDSSYYDPNYLQSDEEKDRFLKIVTKIFNRINNNLAGSILLEELSKANPYLGNDDTPDNQFHIGDASAVEIKFSNGSQHILLPNVIIMGAEPDLFLTYQRNISLRNNYKPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRYKHFKLSNLLNDSIYNISEGYNINNLKVNFRGQNANLNPRIIKPITGRGLVKKIIRF

SEQ ID NO: 99 - protein, 411 aa, Artificial Sequence
  Synthetic polypeptide
MPKINSFNYNDPVNDRTILYIKPGGCHEFYKSFNIMKNIWIIPERNVIGTTPQDFHPPTSLKNGDSSYYDPNYLQSDEEKDRFLKIVTKIFNRINNNLAGSILLEELSKANPYLGNDDTPDNQFHIGDASAVEIKFSNGSQHILLPNVIIMGAEPDLFLTYQRNISLRNNYKPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPRLNPYKDIFQEKYGLDKDASGIYSVNINKFDDILKKLYSFTEFDLATKFQVKCRETYIGRYKPFKLSNLLNDSIYNISEGYNINNLKVNFRGQNANLNPRIIKPITGRGLVKKIIRF

SEQ ID NO: 100 - protein, 411 aa, Artificial Sequence
  Synthetic polypeptide
MPKINSFNYNDPVNDRTILYIKPGGCHEFYKSFNIMKNIWIIPERNVIGTTPQDFHPPTSLKNGDSSYYDPNYLQSDEEKDRFLKIVTKIFNRINNNLAGSILLEELSKANPYLGNDDTPDNQFHIGDASAVEIKFSNGSQHILLPNVIIMGAEPDLFLTYQRNISLRNNYKPSNHGFGSIAIVTFSPEYSFRFNDNSINEFIQDPALTLMHELIHSLHGLYGAKGITTTCTITQQQNPLITNRKGINIEEFLTFGGNDLNIITVAQYNDIYTNLLNDYRKIASKLSKVQVSNPQLNPYKDIFQEKYGLDKDASGIYSVNINKFDDILKKLYSFTEFDLATKFQVKCRETYIGRYKHFKLSNLLNDSIYNISEGYNINNLKVNFRGQNANLNPRIIKPITGRGLVKKIIRF

SEQ ID NO: 101 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLNIIDSIPDKGLVEKIVKF

SEQ ID NO: 102 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKGLVEKIVKF

SEQ ID NO: 103 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKGLVEKIVKF

SEQ ID NO: 104 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVRSSIILNLLVLGAGPDIFESYSYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVEKIVKF

SEQ ID NO: 105 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISDAKPYLGNEHTPINEFHPVTRTTSVNIKSSTNVRSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKGLVEKIVKF

SEQ ID NO: 106 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 107 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPDLLDDDIYTVSEGFNIGNLAVNNRGQNIKLNLKIIDSIPDKGLVEKIVKF

SEQ ID NO: 108 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPDLLDDDIYTVSEGFNIGHLAVNNRGQNIKLNLKIIDSIPDKAWLRKSKF

SEQ ID NO: 109 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 110 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSSDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 111 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGHLAVNNRGQNIKLNLKIIDSIPDKAWLRKSKF

SEQ ID NO: 112 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMASGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKGLVEKIVKF

SEQ ID NO: 113 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 114 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKAGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 115 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDVEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKVLVKKIVKF

SEQ ID NO: 116 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDVEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 117 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFGNYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 118 - protein, 428 aa, Artificial Sequence
  Synthetic polypeptide
MPVVINSFNYNDPVNDDTILYMQIPYEEKSKKYYKAFEIMHNVWIIPERNTIGTDPSDFEPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNETKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 119 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDVYTVSEGFNIGHLAVNNRGQNIKLNLKIIDSIPDKGLVKKIVKF

SEQ ID NO: 120 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLILGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLEIIDSIPDKGLVKKIVKF

SEQ ID NO: 121 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISHAKPYLGNEHTPINEFHPVTRTTSVNIKSSTNVKSSIILNLLVLGAGPNIFGNYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 122 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKAWLRKSKF

SEQ ID NO: 123 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFESYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKAWLRKSKF

SEQ ID NO: 124 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKAWLRKSKF

SEQ ID NO: 125 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFESYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKAWLRKTKF

SEQ ID NO: 126 - protein, 427 aa, Artificial Sequence
  Synthetic polypeptide
MPVVINSFNYNDPVNDDTILYMQIPYEEKNKKYYKAFEIMRNVWIIPERNTIGTDPSDFDPPASLDNGSSAYYDPNYLTTDAEKDRYLKTTIKLFKRINSNPAGEVLLQEISDAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSAESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKAWLRKSKF

SEQ ID NO: 127 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLDNGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMGSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKAWLRKSKF

SEQ ID NO: 128 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGHLAVNNRGQNIKLNLKIIDSIPDKAWLRKSKF

SEQ ID NO: 129 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 130 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYIYPVRKLMDSGGVYDPSKDGFGIINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 131 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYIYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGHLAVNNRGQNIKLNLKIIDSIPDKAWLRKSKF

SEQ ID NO: 132 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYIYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKLNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 133 - protein, 428 aa, Artificial Sequence; identical to SEQ ID NO: 113
  Synthetic polypeptide

SEQ ID NO: 134 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKAGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANHEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 135 - protein, 428 aa, Artificial Sequence; identical to SEQ ID NO: 116
  Synthetic polypeptide

SEQ ID NO: 136 - protein, 428 aa, Artificial Sequence
  Synthetic polypeptide
MPVVINSFNYNDPVNDDTILYMQIPYEEKSKKYYKAFEIMHNVWIIPERNTIGTDPSDFEPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINENKDYFQWKYGLDKNADGSYTVNENKFREIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 137 - protein, 428 aa, Artificial Sequence
  Synthetic polypeptide
MPVVINSFNYNDPVNDDTILYMQIPYEEKSKKYYKAFEVMRNVWIIPERNTIGTDPSDFDPPASLENGSSAYYDPNYLTTDVEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 138 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFVKHGFRKVPNLLDDDIYTVSEGFNIGHLAVNNRGQNIKLNLKIIDSIPDKGLVKKIVKF

SEQ ID NO: 139 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPNIFETYIYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 140 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVSEGFNIGHLAVNNRGQNIKLNLKIIDSIPDKGLVKKIVKF

SEQ ID NO: 141 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFESYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYSVNENKFNEIYKKLYSFTEIDLATKLKVKCRNTYFIKHGFRKVPNLLDDDIYTVSEGFNIGHLAVNNRGQNIKLNLKIIDSIPDKGLVKKIVKF

SEQ ID NO: 142 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYIYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVSEGFNIGHLAVNNRGQNIKLNLKIIDSIPDKGLVKKIVKF

SEQ ID NO: 143 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYIYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYSVNENKFNEIYKKLYSFTEIDLANKLKVKCRNTYFIKHGFRKVPNLLDDDIYTVSEGFNIGHLAVNNRGQNIKLNLKIIDSIPDKGLVKKIVKF

SEQ ID NO: 144 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYIYPVRRLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVSEGFNIGHLAVNNRGQNIKLNLKIIDSIPDKGLVKKIVKF

SEQ ID NO: 145 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYIYPVRKLMDSGGVYDPSKDGFGSINIVTFSSEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVSEGFNIGHLAVNNRGQNIKLNLKIIDSIPDKGLVKKIVKF

SEQ ID NO: 146 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLSTDAEKDRYLKTTIKLFKRINSNPAGEVLLQEISYAKPYLGNEHTPINEFHPVTRTTSVNIKSSTNVKSSIILNLLVLGAGPDIFENYIYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVSEGFNIGHLAVNNRGQNIKLNLKIIDSIPDKGLVKKIVKF

SEQ ID NO: 147 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYIYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLSNYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVSEGFNIGHLAVNNRGQNIKLNLKIIDSIPDKGLVKKIVKF

SEQ ID NO: 148 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPNIFENYIYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 149 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPNIFENYSYPVRKLMDSGGVYDPSKDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 150 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTIVNIKSSTNVKSSIILNLLVLGAGPNIFENYSYPVRKLMDSGGVYDPSKDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLYDDIYTVSEGFNIGHLAVNNRGQNIKLNLKIIDSIPDKGLVKKIVKF

SEQ ID NO: 151 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPNIFENYSYPVRKLMDSGGVYDPSKDGFGSINIVTFSPEYKYTFNDISGGYNSSTESFIADPAISLAHELIHALHGLYGALGVTYKETIKVKQAPLMIAEKPIRLEEFLTFGGQDLNIITSAMEEKIYNNLLANYEKIATRLSRVNSAPPEYDINEYKDYFQWKYGLDKNADGSYTVNETKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 152 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPNIFENYSYPVRKLMDSGGVYDPSKDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLVANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 153 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPNIFENYSYPVRKLMDSGGVYDPSKDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKNLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 154 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSHVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 155 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNDHTPINEFHPVTRTTSVNIKSSTNVKSSIILNLLVLGAGPNIFETYIYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 156 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYGYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVSEGFNIGHLAVNNRGQNIKLNLKIIDSIPDKGLVKKIVKF

SEQ ID NO: 157 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPNIFESYIYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 158 - protein, 428 aa, Artificial Sequence; identical to SEQ ID NO: 139
  Synthetic polypeptide

SEQ ID NO: 159 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPNIFETYIYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVSEGFNIGHLAVNNRGQNIKLNLKIIDSIPDKGLVKKIVKF

SEQ ID NO: 160 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPNIFETYIYPVRRLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVNEGFNIGHLAVNNRGQNIKLNLKIIDSIPDKGLVKKIVKF

SEQ ID NO: 161 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNKHTPINEFHPVTRTTSVNIKSSTNVKSSIILNLLVLGAGPNIFETYIYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVSEGFNIGHLAVNNRGQNIKLNLKIIDSIPDKGLVKKIVKF

SEQ ID NO: 162 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNKHTPINEFHPVTRTTSVNIKSSTNVKSSIILNLLVLGAGPNIFETYIYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQELNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVSEGFNIGHLAVNNRGQNIKLNLKIIDSIPDKGLVKKIVKF

SEQ ID NO: 163 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNKHTPINEFHPVTRTTSVNIKSSTNVKSSIILNLLVLGAGPNIFETYIYPVRKLMDSGGVYDPSKDGFGSINIMTFSPEYEYTFNDISGGYNSSTESFIADPAISLAHELIHALHGLYGALGVTYKETIKVKQSPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVSEGFNIGHLAVNNRGQNIKLNLKIIDSIPDKGLVKKIVKF

SEQ ID NO: 164 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPNIFENYSYPVRKLMDSGGVYDPSKDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKAWLRKSKF

SEQ ID NO: 165 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPNIFENYSYPVRKLMDSGGVYDPSKDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYSVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 166 - protein, 428 aa, Artificial Sequence; identical to SEQ ID NO: 149
  Synthetic polypeptide

SEQ ID NO: 167 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPNIFENYSYPVRKLMDSGGVYDPSKDGFGSINIVTFSPEYKYTFNDISGGCNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 168 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPNIFENYSYPVRKLMDSGGVYDPSKDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKNLYSFTEIDLANKLKVKCRNTYFIKHGFLKVPNLLDDDIYTVSEGFNIGHLAVNNRGQNIKLNLKIIDSIPDKAWLRKSKF

SEQ ID NO: 169 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYEYTFNDISGGYNSSTESFIADPAISLAHELIHALHGLYGALGVTYKETIKVKQAPLMIAEKPIRLEEFLTFGGQDLNIICSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 170 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPNIFENYSYPVRKLMDSGGVYDPSKDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIAMRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 171 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSSESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIDPIPDKGLVEKIVKF

SEQ ID NO: 172 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLSGARGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKYGFLKVPDLLDDDIYTVSEGFNIGNLAVNNRGQNIKLNPKIIDSIPDKGLVEKIVKF

SEQ ID NO: 173 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIAMRLSRVNSAPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIDSVPDKGLVEKIVKF

SEQ ID NO: 174 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIDSIPDKGLVEKIVKF

SEQ ID NO: 175 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEDTFNDISGGYDSSTESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNEDGSYTVNENKFNEIYKKLYSFTEIDLANKFKVKCRNTYFIKHGFLKVPDLLDDDIYTVSEGFNIGNLAVNNRGQNIKLNPKIIDSIPDKGLVEKIVKF

SEQ ID NO: 176 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSSESFIADPAISLAHELIHALHGLYGARGVTYKETIKVKQAPLMIAEKPIRLEEFLTFGGQDLNIITSAMKEKIYNNLLANYEKIATRLSRVTSAPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIDSIPDKGLVEKIVKF

SEQ ID NO: 177 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDNGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKDADGSYTVNENKFNEIYKKLYSFTEIDLANKFKVKCRNTYFIKYGFLKVPDLLDDDIYTVSEGFNIGNLAVNNRGQNIKLNPKIIDSIPDKGLVEKIVKF

SEQ ID NO: 178 - protein, 428 aa, Artificial Sequence
  Synthetic polypeptide
MPVVINSFNYNDPVNDDTILYMQIPYEEKSKKYYKAFEIMHNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKYGFLKVPDLLDDDIYTVSEGFNIGNLAVNNRGQNIKLNPKIIDSIPDKGLVEKIVKF

SEQ ID NO: 179 - protein, 428 aa, Artificial Sequence
  Synthetic polypeptide
MPVVINSFNYNDPVNDDTILYMQIPYEEKSKKYYKAFEIMHNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNKNKFNEIYKKLYSFTEIDLANKFKVKCRNTYFIKYGFLKVPDLLDDDIYTVSEGFNIGNLAVNNRGQNIKLNPKIIDSIPDKGLVEKIVKF

SEQ ID NO: 180 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKYGFLKVPDLLDDDIYTVSEGFNIGNLAVNNRGQNIKLNPKIIDSIPDKGLVEKIVKF

SEQ ID NO: 181 - protein, 428 aa, Artificial Sequence
  Synthetic polypeptide
MPVVINSFNYNDPVNDDTILYMQIPYEEKSKKYYKAFEIMRNVWIIPERNTIGTNPSDFDPPASLENGSSAYYDPNYLTTDAEKDRYLKTTIKLFNRINSNPAGEVLLQEISSAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEELLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIGSIPDKGLVEKIVKF

SEQ ID NO: 182 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSHDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKNYNNLLANYEKIATRLSRVNSAPPEYDINEYKDYFQWKYGLDKNADGSYTVNENKFNEIYKKLYSFTEIDLANKFKVKCRNTYFIKYGFLKVPDLLDDDIYTVSEGFNIGNLAVNNRGQNIKLNPKIIDSIPDKGLVEKIVKF

SEQ ID NO: 183 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEELLTFGGQDLNIITSAMKEKIYNNLLANYEKIATHLSHVNSAPPEYDINEYKDYFQWKYGLDKNADGSYTVNENKFNEIYKKLYSFTEIDLANKFKVKCRNTYFIKYGLLKVPDLLDDDIYTVSEGFNIGNLAVNNRGQNIKLNPKIIDSIPDKGLVEKIVKF

SEQ ID NO: 184 - protein, 428 aa, Artificial Sequence
  Synthetic polypeptide
MPVVINSFNYNDPVNDDTILYMQIPYEEKSKKYYKAFEIMHNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNPKIIGSIPDKGLVEKIVKF

SEQ ID NO: 185 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKHGFLKVPNLLDDDIYTVSEGFNIGNLAVNNRGQNIKLNPKIIDSIPDKGLVEKIVKF

SEQ ID NO: 186 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNPKIIDSIPDKGLVEKIVKF

SEQ ID NO: 187 - protein, 428 aa, Artificial Sequence
  Synthetic polypeptide
MPVVINSFNYNDPVNDDTILYMQIPYEEKSKKYYKAFEIMHNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAGKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNPKIIGSIPDKGLVEKIVKF

SEQ ID NO: 188 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAGKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNPKIIDSIPDKGLVEKIVKF

SEQ ID NO: 189 - protein, 428 aa, Artificial Sequence
  Synthetic polypeptide
MPVVINSFNYNDPVNDDTILYMQIPYEEKSKKYYKAFEIMHNVWIIPERNTIGTDPSDFDPPASLENGSSAYYDPNYLTTDAEKDRYLKTTIKLFKRINSNPAGEVLLHEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKAKCRNTYFIKHGFLKVPNLLDDDIYTVSEGFNIGNLAVNNRGQNIKLNPKIIGSIPDKGLVEKIVKF

SEQ ID NO: 190 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRININPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIDSIPDKGLVEKIVKF

SEQ ID NO: 191 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNDHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEELLTFGGQDLNIITSAMKEKIYNNLLANYEKIATRLSRVNSAPPEYDINEYKDYFQWKYGLDKNADGSYTVNENKFNEIYKKLYSFTEIGLANKFKVKCRNTYFIKYGFLKVPNLLDDDIYTVSEGFNIGNLAVNNRGQNIKLNPKIIDSIPDKGLVEKIVKF

SEQ ID NO: 192 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIDSIPDKGLVEKIVKF

SEQ ID NO: 193 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPVGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIDSIPDKGLVEKIVKF

SEQ ID NO: 194 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNEDGSYTVNENKFNEIYKKLYSFTEIDLANKFKVKCRNTYFIKYGFLKVPNLLDDDIYTVSEGFNIGNLAVNNRGQNIKLNPKIIDSIPDKGLVEKIVKF

SEQ ID NO: 195 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIDSIPDKGLVEKIVKS

SEQ ID NO: 196 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADRAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIDSIPDKGLVEKIVKF

SEQ ID NO: 197 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIATRLSRVNSSPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIDSIPDKGLVEKIVKF

SEQ ID NO: 198 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLSNYEKIATRLSRVNSAPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIDSIPDKGLVEKIVKF

SEQ ID NO: 199 - protein, 428 aa, Artificial Sequence; identical to SEQ ID NO: 190
  Synthetic polypeptide

SEQ ID NO: 200 - protein, 428 aa, Artificial Sequence; identical to SEQ ID NO: 191
  Synthetic polypeptide

SEQ ID NO: 201 - protein, 428 aa, Artificial Sequence; identical to SEQ ID NO: 192
  Synthetic polypeptide

SEQ ID NO: 202 - protein, 428 aa, Artificial Sequence; identical to SEQ ID NO: 193
  Synthetic polypeptide

SEQ ID NO: 203 - protein, 428 aa, Artificial Sequence; identical to SEQ ID NO: 194
  Synthetic polypeptide

SEQ ID NO: 204 - protein, 428 aa, Artificial Sequence; identical to SEQ ID NO: 195
  Synthetic polypeptide

SEQ ID NO: 205 - protein, 428 aa, Artificial Sequence; identical to SEQ ID NO: 196
  Synthetic polypeptide

SEQ ID NO: 206 - protein, 428 aa, Artificial Sequence; identical to SEQ ID NO: 197
  Synthetic polypeptide

SEQ ID NO: 207 - protein, 428 aa, Artificial Sequence; identical to SEQ ID NO: 198
  Synthetic polypeptide

SEQ ID NO: 208 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENSSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIDSIPDKGLVEKIVKF

SEQ ID NO: 209 - protein, 428 aa, Artificial Sequence; identical to SEQ ID NO: 192
  Synthetic polypeptide

SEQ ID NO: 210 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSTPAGEVLLQEISYAKPYLGNEHTPINEFHPVTRTTSVNIKSSTNVKSSIILNLLVLGAGPDIFENYSYPVRKLMDSGGVYDPSNDGFGSINIVTFSPEYEYTFNDISGGYNSSTESFIADPAISLAHELIHALHGLYGARGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKFKVKCRNTYFIKYGFLKVPNLLDDDIYTVSEGFNIGNLAVNNRGQNIKLNPKIIDSIPDKGLVEKIVKF

SEQ ID NO: 211 - protein, 428 aa, Artificial Sequence; identical to SEQ ID NO: 208
  Synthetic polypeptide

SEQ ID NO: 212 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPTSLDNGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMGSGGVYDPSKDGFGSINIVTFSPEYGYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKAWLRKSKF

SEQ ID NO: 213 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISDAKPYLGNEHTPINEFHPVTRTTSVNIKSSTNVKSSIILNLLVLGAGPDIFENYSYPVRKLMDSGGVYDPSNDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKVLVEKIVKF

SEQ ID NO: 214 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLKNGSSAYYDPNYLTTDAEKDRYLKTTIKLFKRINSNPAGEALLQEISDAKPYLGNEHTPINEFHPVTRTTSVNIKSSTNVKSSIILNLLVLGAGPDIFENYSYPVRKLMDSGGVYDPSHDGFGSINIVTFSPEYKYTFNDISGGYNSSTESFIADPAISLAHELIHALHGLYGALGVAYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKVLIEKIVKF

SEQ ID NO: 215 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISSAKPYLGNEHTPINEFHPVTRTTSVNIKSSTNVKSSIILNLLVLGAGPDIFENYSYPVRKLMDGGGVYDPSNDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKGWLRKSKF

SEQ ID NO: 216 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISSAKPYLGNEHTPINEFHPVTRTTSVNIKSSTNVKSSIILNLLVLGAGPDIFENYSYPVRKLMDSGGVYDPSHDGFGSINIVTFSPEYKYTFNDISGDYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKGWLRKSKF

SEQ ID NO: 217 - protein, 428 aa, Artificial Sequence
  Synthetic polypeptide
MPVVINSFNYSDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISDAKPYLGNEHTPINEFHPVTRTTSVNIKSSTNVKSSIILNLLVLGAGPDIFENYSYPVRKLMDSGGVYDPSNDGFGSINIVTFSPEYKYTFNDISGGYNSSAESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKVLVEKIVKF

SEQ ID NO: 218 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISDAKPYLGNEHTPINEFYPVTRTTSVNIKSSTNVKSSIILNLLVLGAGPDIFENYSYPVRKLMDSGGVYDPSNDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKVLVEKIVKF

SEQ ID NO: 219 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISDAKPYLGNEHTPINEFHPVTRTTSVNIKSSTNVKSSIILNLLVLGAGPDIFENYSYPVRKLMDSGGVYDPSHDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKAWLRKSKF

SEQ ID NO: 220 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYSYPVRKLMDSGGVYDPSSDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 221 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYSYPVRKLMDSGGVYDPSSDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGHLAVNNRGQNIKLNLKIIDSIPDKAWLRKSKF

SEQ ID NO: 222 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISDAKPYLGNEHTPINEFHPVTRTTSVNIKSSTNVKSSIILNLLVLGAGPDIFENYCYPVRKLMDSGGVYDPSHDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGHLAVNNRGQNIKLNLKIIDSIPDKAWLRKSKF

SEQ ID NO: 223 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISDAKPYLGNEHTPINEFHPVTRTTSVNIKSSTNVKSSIILNLLVLGAGPDIFENYSYPVRKLMDSGGVYDPSHDGFGSINIVTFSPEYKYTFNDISGGYNSSTESFIADPAISLAHELIHALHGLYGALGVTYKETIKVKQAPLMIAEKPIRLEEFLTFGGQDLNLITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 224 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPDYLTTDAEKDRYLKTTIKLFKRINSNPAGEALLQEISDAKPYLGNEHTPINEFHPVTRTTSVNIKSSTNVKSSIILNLLVLGAGPDIFENYSYPVRKLMDSGGVYDPSHDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 225 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYKYTFNDISGGYNSSTESFIADPAISLAHELIHALHGLYGALGVTCKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYIFTEIDLANKLKVKCRNTYFIKHGFLKVPNLLDDDIYTVSEGFNIGHLAVNNRGQNIKLNLKIIDSIPDKGLVKKIVKF

SEQ ID NO: 226 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYSYPVRKLMDSGGVYDPSKDGFGSINIVTFSPEYKYTFNDISGGYNSSTESFIADPAISLAHELIHALHGLYGALGVTCKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 227 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYKYTFNDISGGYNSSTESFIADPAISLAHELIHALHGLYGALGVTCKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 228 - protein, 428 aa, Artificial Sequence; identical to SEQ ID NO: 208
  Synthetic polypeptide

SEQ ID NO: 229 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLDNGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMGSGGVYDPSKDGFGSINIVTFSPEYGYTFNDISGGYNSSTESFIADPAIILAHELIHALHGLYGAFGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKAWLRKSKF

SEQ ID NO: 230 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLDNGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMGSGGVYDPSKDGFGSINIVTFSPEYGYTFNDISGGYNSSTESFIADPAIILAHELIHALHGLYGAFGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPDLLDDDIYTVSEGFNIGNLAVNNRGQNIKLNLKIIDSIPDKAWLRKSKF

SEQ ID NO: 231 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLDNGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMGSGGVYDPSKDGFGSINIVTFSPEYGYTFNDISGGYNSSGESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIEHGFLKVPNLLDDDIYTVSEGFNIGNLAVNNRGQNIKLNLKIIDSIPDKAWLRKSKF

SEQ ID NO: 232 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYIYPVRKLMDSGGVYDPSNDGFGSINIVTFSPEYGYTFNDISGGYHSSTESFIADPAIILAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGHLAVNNRGQNIKLNLKIIDSIPDKAWLRKSKF

SEQ ID NO: 233 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYIYPVRKLMDSGGVYDPSNDGFGSINIVTFSPEYGYTFNDISGGYNSSTESFIADPAIILAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGHLAVNNRGQNIKLNLKIIDSIPDKAWLRKSKF

SEQ ID NO: 234 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPDYLTTDAEKDRYLKTTIKLFKRINSNPAGEALLQEISYAKPYLGNEHTPINEFHPVTRTTSVNIKSSTNVKSSIILNLLVLGAGPDIFENYIYPVRKLMDSGGVYDPSNDGFGSINIVTFSPEYGYTFNDISGGYNSSTESFIADPAIILAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGHLAVNNRGQNIKLNLKIIDSIPDKAWLRKSKF

SEQ ID NO: 235 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYGYTFNDISGGYNSSTESFIADPAIILAHELIHALHGLYGAFGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 236 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYGYTFNDISGGYNSSTESFIADPAISLAHELIHALHGLYGAFGVTYKETIKVKQAPLMIAEKPIRLEEFLTFGGQDLNIITSAMKEKIYNNLLANYEKIATRLSRVNSAPPEYDINEYKDYFQWKYGLDKNADGSYSVNENKFNEIYKKLYSFTEIDLANKLKVKCRNTYFIKHGFLKVPNLLDDDIYTVSEGFNIGHLAVNNRGQNIKLNLKIIDSIPYKGLVKKIVKF

SEQ ID NO: 237 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSFAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYGYTFNDISGGYNSSTESFIADPAISLAHELIHALHGLYGAFGVTIKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVSEGFNIGHLAVNNRGQNIKLNLKIIDSIPDKGLVKKIVKF

SEQ ID NO: 238 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPDSLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYGYTFNDISGGYNSSTESFIADPAISLAHELIHALHGLYGALSVTIKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 239 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYGYTFNDISGGYNSSTESFIADPAISLAHELIHALHGLYGAFGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 240 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSFAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYGYTFNDISGGYNSSTESFIADPAISLAHELIHALHGLYGALGVTIKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVSEGFNIGHLAVNNRGQNIKLNLKIIDSIPDKGLVKKIVKF

SEQ ID NO: 241 - protein, 428 aa, Artificial Sequence; identical to SEQ ID NO: 208
  Synthetic polypeptide

SEQ ID NO: 242 - protein, 427 aa, Artificial Sequence; identical to SEQ ID NO: 229
  Synthetic polypeptide

SEQ ID NO: 243 - protein, 427 aa, Artificial Sequence; identical to SEQ ID NO: 230
  Synthetic polypeptide

SEQ ID NO: 244 - protein, 427 aa, Artificial Sequence; identical to SEQ ID NO: 231
  Synthetic polypeptide

SEQ ID NO: 245 - protein, 427 aa, Artificial Sequence; identical to SEQ ID NO: 232
  Synthetic polypeptide

SEQ ID NO: 246 - protein, 427 aa, Artificial Sequence; identical to SEQ ID NO: 233
  Synthetic polypeptide

SEQ ID NO: 247 - protein, 427 aa, Artificial Sequence; identical to SEQ ID NO: 234
  Synthetic polypeptide

SEQ ID NO: 248 - protein, 428 aa, Artificial Sequence; identical to SEQ ID NO: 235
  Synthetic polypeptide

SEQ ID NO: 249 - protein, 428 aa, Artificial Sequence; identical to SEQ ID NO: 236
  Synthetic polypeptide

SEQ ID NO: 250 - protein, 428 aa, Artificial Sequence; identical to SEQ ID NO: 237
  Synthetic polypeptide

SEQ ID NO: 251 - protein, 428 aa, Artificial Sequence; identical to SEQ ID NO: 238
  Synthetic polypeptide

SEQ ID NO: 252 - protein, 428 aa, Artificial Sequence; identical to SEQ ID NO: 239
  Synthetic polypeptide

SEQ ID NO: 253 - protein, 428 aa, Artificial Sequence; identical to SEQ ID NO: 240
  Synthetic polypeptide

SEQ ID NO: 254 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLDNGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMGSGGVYDPSKDGFGSINIVTFSPEYGYTFNDISGGYNSSTESFIADPAISLAHELIHALHGLYGAFGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKAWLRKSKF

SEQ ID NO: 255 - protein, 427 aa, Artificial Sequence; identical to SEQ ID NO: 229
  Synthetic polypeptide

SEQ ID NO: 256 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLDNGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMGSGGVYDPSKDGFGSINIVTFSPEYGYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIEHGFLKVPNLLDDDIYTVSEGFNIGNLAVNNRGQNIKLNLKIIDSIPDKAWLRKSKF

SEQ ID NO: 257 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISDAKPYLGNEHTPINEFHPVTRTTSVNIKSSTNVKSSIILNLLVLGAGPDIFENYCYPVRKLMDSGGVYDPSHDGFGSINIVTFSPEYGYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 258 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISDAKPYLGNEHTPINEFHPVTRTTSVNIKSSTNVKSSIILNLLVLGAGPDIFENYIYPVRKLMDSGGVYDPSHDGFGSINIVTFSPEYGYTFNDISGGHNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 259 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSIPAGEVLLQEISYAKPYLGNEHTPINEFHPVTRTTSVNIKSSTNVKSSIILNLLVLGAGPDIFENYCYPVRKLMDSGGVYDPSHDGFGSINIVTFSPEYGYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 260 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISDAKPYLGNEHTPINEFHPVTRTTSVNIKSSTNVKSSIILNLLVLGAGPDIFENYSYPVRKLMDSGGVYDPSSDGFGSINIVTFSPEYGYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPDLLDDDIYTVSEGFNIGHLAVNNRGQNIKLNLKIIDSIPDKAWLRKSKF

SEQ ID NO: 261 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYIYPVRKLMDSGGVYDPSHDGFGSINIVTFSPEYAYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGHLAVNNRGQNIKLNLKIIDSIPDKAWLRKSKF

SEQ ID NO: 262 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYGYTFNDISGGYNSSTESFIADPAIILAHELIHALHGLYGAFGVTYKETIKVKQAPLMIAEKPIRLEEFLTFGGQDLNIITSAMKEKIYNNLLANYEKIATRLSRVNSAPPEYDINEYKDYFQWKYGLDKNADGSYSVNENKFNEIYKKLYSFTEIDLANKLKVKCRNTYFIKHGFLKVPNLLDDDIYTVSEGFNIGHLAVNNRGQNIKLNLKIIDSIPYKGLVKKIVKF

SEQ ID NO: 263 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYGYTFNDINGGYNSSTESFIADPAIILAHELIHALHGLYGAFGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPNLLDDDIYTVSEGFNIGHLAVNNRGQNIKLNLKIIDSIPYKGLVKKIVKF

SEQ ID NO: 264 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYGYTFNDISGGYNSSTESFIADPAIILAHELIHALHGLYGAFGVTYKETIKVKQAPLMIAEKPIRLEEFLTFGGQDLNIITSAMKEKIYNNLLANYEKIATRLSRVNSAPPEYDINEYKDYFQWKYGLDKNADGSYSVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 265 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYGYTFNDISGGYNSSTESFIADPAIILAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYSVNENKFNEIYKKLYSFTEIDLANKLKVKCRNTYFIKHGFLKVPNLLDDDIYTVSEGFNIGHLAVNNRGQNIKLNLKIIDSIPYKGLVKKIVKF

SEQ ID NO: 266 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYSYPVRKLMDSGGVYDPSKDGFGSINIVTFSPEYGYTFNDISGGYNSSTKSFIADPAIILAHELIHALHGLYGALGVTCKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIEHGFLKVPNLLDDDIYTVSEGFNIGHLAVNNRGQNIKLNLKIIDSIPDKGLVKKIVKF

SEQ ID NO: 267 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSVNIVTFSPEYGYTFNDISGGYNSSTESFIADPAIILAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYSVNENKFNEIYKKLYSFTEIDLANKLKVKCRNTYFIKHGFLKVPNLLDDDIYTVSEGFNIGHLAVNNRGQNIKLNLKIIDSIPYKGLVKKIVKF

SEQ ID NO: 268 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYGYTFNDISGGYNSSTESFIADPAIILAHELIHALHGLYGAFGVTYKETIKVKQAPLMIAEKPIRLEEFLTFGGQDLNIITSAMKEKIYNNLLANYEKIATRLSRVNSAPPGYDINEYKDYFQWKYGLDKNADGSYSVNENKFNEIYKKLYSFTEIDLANKLKVKCRNTYFIKHGFLKVPNLLDDDIYTVSEGFNIGHLAVNNRGQNIKLNLKIIDSIPYKGLVKKIVKF

SEQ ID NO: 269 - protein, 427 aa, Artificial Sequence; identical to SEQ ID NO: 254
  Synthetic polypeptide

SEQ ID NO: 270 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPTSLDNGSSAYYDPNYLTTDAEKDRYLKTTIKLFKRINSNPAGEVLLQEISYAKPYLGNEHTPINEFHPVTRTTSVNVKSSTNVKSSIILNLLVLGAGPDIFENYSYPVRKLMGSGGVYDPSKDGFGSINIVTFSPEYGYTFNDISGGYNSSTESFIADPAISLAHELIHALHGLYGAFGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGNLAVNNRGQNIKLNLKIIDSIPDKAWLRKSKF

SEQ ID NO: 271 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLDNGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMGSGGVYDPSKDGFGSINIVTFSPEYGYTFNDISGGYNSSTGSFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIEHGFLKVPNLLDDDIYTVSEGFNIGNLAVNNRGQNIKLNLKIIDSIPDKAWLRKSKF

SEQ ID NO: 272 - protein, 427 aa, Artificial Sequence; identical to SEQ ID NO: 220
  Synthetic polypeptide

SEQ ID NO: 273 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISDAKPYLGNEHTPINEFHPVTRTTSVNIKSSTNVKSSIILNLLVLGAGPDIFENYCYPVRKLMDSGGVYDPSHDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 274 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPDYLTTDAEKDRYLKTTIKLFKRINSNPAGEVLLQEISDAKPYLGNEHTPINEFHPVTRTTSVNIKSSTNVKSSIILNLLVLGAGPDIFENYCYPVRKLMDSGGVYDPSHDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 275 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISDAKPYLGNEHTPINEFHPVTRTTSVNIKSSTNVKSSIILNLLVLGAGPDIFENYCYPVRKLMDSGGVYDPSHDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 276 - protein, 427 aa, Artificial Sequence
  Synthetic polypeptide
MPVVINSFNYNDPVNDDTILYMQIPYEEKSKKYYKAFEIMRNVWIIPERNTIGTDPSDFYPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYSYPVRKLMDSGGVYDPSSDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPDLLDDDIYTVSEGFNIGHLAVNNRGQNIKLNLKIIDSIPDKAWLRKSKF

SEQ ID NO: 277 - protein, 427 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISDAKPYLGNEHTPINEFHPVTRTTSVNIKSSTNVKSSIILNLLVLGAGPDIFENYSYPVRKLMDSGGVYDPSHDGFGSINIVTFSPEYKYTFNDISGGYNSSTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGNLAVNNRGQNIKLNLKIIDSIPDKAWLRKSKF

SEQ ID NO: 278 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYKYTFNDISGGYNSSTESFIADPAISLAHELIHALHGLYGALGVTCKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFRKVPDLLDDDIYTVSEGFNIGHLAVNNRGQNIKLNLKIIDSIPDKCLVKKIVKF

SEQ ID NO: 279 - protein, 428 aa, Artificial Sequence
  Synthetic polypeptide
MPVVINSFNYNDPVNDDTILYMQIPYEEKSKKYYKAFEITRNVWIIPERNTIGTDPSDFDPPASLENGSSAYYDPNYLTTDAEKDRYLKTTIKLFKRINSNPAGAVLLQEISYAKPYLGNEHTPINEFHPVTRTTSVNIKSSTNVKSSIILNLLVLGAGPDIFENYSYPVRKLMDSGGVYDPSKDGFGSINIVTFSPEYKYTFNDISGGYNSSTESFIADPAISLAHELIHALHGLYGALGVTCKETIKVKQAPLMIAEKPIRLEEFLTFGGQDLNIITSAMKEKIYNNLLANCEKIATRLSRVNSAPPEYDINEYKDYFQWKYGLDKNADGSYTVNENKFNEIYKKLYSFTEIDLANKLKVKCRNTYFIEHGFLKVPNLLDDDIYTVSEGFNIGHLAVNNRGQNIKLNLKIIDSIPDKGLVKKIVKF

SEQ ID NO: 280 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGAVLLQEISYAKPYLGNEHTPINEFHPVTRTTSVNIKSSTNVKSSIILNLLVLGAGPDIFENYSYPVRKLMDSGGVYDPSKDGFGSINIVTFSPEHKYTFNDISGGYNSSTESFIADPAISLAHELIHALHGLYGALGVTCKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 281 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYGYTFNDISGGYNSYTESFIADPAISLAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDVYTVSEGFNIGHLAVNNRGQNIKLNLKIIDSIPDKGLVKKIVKF

SEQ ID NO: 282 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFYPVTRTTSVNIKSSTNVKSSIILNLLVLGAGPDIFENYSYPVRKLMDSGGVYDPSKDGFGSINIVTFSPEYKYTFNDISGGYNSSTESFIADPAISLAHELIHALHGLYGALGVTCKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 283 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEVLLQEISYAKPYLGNEHTPINEFHPVTRTTSVNIKSSTNVKSSIILNLLVLGAGPDIFENYSYPVRKLMDSGGVYDPSKDGFGSINIVTFSPEYKYTFNDISGGYNSSTESFIADPAISLAHELIHALHGLYGAFGVTYKETIKVKQAPLMIAEKPIRLEEFLTFGGQDLNIITSAMKEKIYNNLLANYEKIATRLSRVNSAPPEYDINEYKDYFQWKYGLDKNADGSYSVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 284 - protein, 428 aa, Artificial Sequence
  Synthetic polypeptide
MPVVINSFNYNDPVNDDTILYMQIPYEEKSKKYYKAFEIMRNVWIIPERNTIGTDPSDFDPPASLENGSFAYYDPNYLTTDAEKDRYLKTTIKLFKRINSNPAGEVLLQEISYAKPYLGNEHTPINEFHPVTRTTSVNIKSSTNVKSSIILNLLVLGAGPDIFKNYSYPVRKLMDSGGVYDPSKDGFGSINIVTFSPEYGYTFNDISGGYNSSTESFIADPAISLAHELIHALHGLYGAFGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYSFTEIDLANKLKVKCRNTYFIKHGFLKVPNLLDDDIYTVSEGFNIGHLAVNNRGQNIKLNLKIIDSIPDKGLVKKIVKF

SEQ ID NO: 285 - protein, 428 aa, Artificial Sequence; identical to SEQ ID NO: 208
  Synthetic polypeptide

SEQ ID NO: 286 - protein, 411 aa, Clostridium botulinum; identical to SEQ ID NO: 19

SEQ ID NO: 287 - protein, 428 aa, Clostridium botulinum; identical to SEQ ID NO: 208

SEQ ID NO: 288 - protein, 179 aa, Artificial Sequence
  Synthetic polypeptide
MAILFAVVARGTTILAKHAWCGGNFLEDFERSRAFNFLNEIKKRFQTTYGSRAQTALPYAMNSEFSSVLAAQLKHHSENKGLDKVMETQAQVDELKGIMVRNIDLVAQRGERLELLIDKTENLVDSSVTFKTTSRNLARAMCMKNLKLTIIIIIVSIVFIYIIVSPLCGGFTWPSCVKK

SEQ ID NO: 289 - protein, 100 aa, Artificial Sequence
  Synthetic polypeptide
MEEASEGGGNDRVRNLQSEVEGVKNIMTQNVERILARGENLEHLRNKTEDLEATSEHFKTTSQKVARKFWWKNVKMIVLICVIVFIIILFIVLFATGAFS

SEQ ID NO: 290 - protein, 116 aa, Artificial Sequence
  Synthetic polypeptide
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVRRG

SEQ ID NO: 291 - protein, 116 aa, Artificial Sequence
  Synthetic polypeptide
MSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIVYFST

SEQ ID NO: 292 - protein, 206 aa, Artificial Sequence
  Synthetic polypeptide
MAEDADMRNELEEMQRRADQLADESLESTRRMLQLVEESKDAGIRTLVMLDEQGEQLERIEEGMDQINKDMKEAEKNLTDLGKFCGLCVCPCNKLKSSDAYKKAWGNNQDGVVASQPARVVDEREQMAISGGFIRRVTNDARENEMDENLEQVSGIIGNLRHMALDMGNEIDTQNRQIDRIMEKADSNKTRIDEANQRATKMLGSG

SEQ ID NO: 293 - protein, 211 aa, Artificial Sequence
  Synthetic polypeptide
MDNLSSEEIQQRAHQITDESLESTRRILGLAIESQDAGIKTITMLDEQKEQLNRIEEGLDQINKDMRETEKTLTELNKCCGLCVCPCNRTKNFESGKAYKTTWGDGGENSPCNVVSKQPGPVTNGQLQQPTTGAASGGYIKRITNDAREDEMEENLTQVGSILGNLKDMALNIGNEIDAQNPQIKRITDKADTNRDRIDIANARAKKLIDS

SEQ ID NO: 294 - protein, 403 aa, Artificial Sequence [sequence omitted]

SEQ ID NO: 295 - protein, 431 aa, Artificial Sequence
  Synthetic polypeptide
CKSVIPRKGTKAPPRLCIRVNNRELFFVASESSYNENDINTPKEIDDTTNLNNNYRNNLDEVILDYNSETIPQISNQTLNTLVQDDSYVPRYDSNGTSEIEEHNVVDLNVFFYLHAQKVPEGETNISLTSSIDTALSEESQVYTFFSSEFINTINKPVHAALFISWINQVIRDFTTEATQKSTFDKIADISLVVPYVGLALNIGNEVQKENFKEAFELLGAGILLEFVPELLIPTILVFTIKSFIGSSENKNKIIKAINNSLMERETKWKEIYSWIVSNWLTRINTQFNKRKEQMYQALQNQVDAIKTVIEYKYNNYTSDERNRLESEYNINNIREELNKKVSLAMENIERFITESSIFYLMKLINEAKVSKLREYDEGVKEYLLDYISEHRSILGNSVQELNDLVTSTLNNSIPFELSSYTNDKILILYF

SEQ ID NO: 296 - protein, 419 aa, Artificial Sequence
  Synthetic polypeptide
NKLYKKIKDNSILDMRYENNKFIDISGYGSNISINGDVYIYSTNRNQFGIYSSKPSEVNIAQNNDIIYNGRYQNFSISFWVRIPKYFNKVNLNNEYTIIDCIRNNNSGWKISLNYNKIIWTLQDTAGNNQKLVFNYTQMISISDYINKWIFVTITNNRLGNSRIYINGNLIDEKSISNLGDIHVSDNILFKIVGCNDTRYVGIRYFKVFDTELGKTEIETLYSDEPDPSILKDFWGNYLLYNKRYYLLNLLRTDKSITQNSNFLNINQQRGVYQKPNIFSNTRLYTGVEVIIRKNGSTDISNTDNFVRKNDLAYINVVDRDVEYRLYADISIAKPEKIIKLIRTSNSNNSLGQIIVMDSIGNNCTMNFQNNNGGNIGLLGFHSNNLVASSWYYNNIRKNTSSNGCFWSFISKEHGWQEN

SEQ ID NO: 297 - protein, 438 aa, Artificial Sequence
  Synthetic polypeptide
CKNIVSVKGIRKSICIEINNGELFFVASENSYNDDNINTPKEIDDTVTSNNNYENDLDQVILNFNSESAPGLSDEKLNLTIQNDAYIPKYDSNGTSDIEQHDVNELNVFFYLDAQKVPEGENNVNLTSSIDTALLEQPKIYTFFSSEFINNVNKPVQAALFVSWIQQVLVDFTTEANQKSTVDKIADISIVVPYIGLALNIGNEAQKGNFKDALELLGAGILLEFEPELLIPTILVFTIKSFLGSSDNKNKVIKAINNALKERDEKWKEVYSFIVSNWMTKINTQFNKRKEQMYQALQNQVNAIKTIIESKYNSYTLEEKNELTNKYDIKQIENELNQKVSIAMNNIDRFLTESSISYLMKLINEVKINKLREYDENVKTYLLNYIIQHGSILGESQQELNSMVTDTLNNSIPFKLSSYTDDKILISYFNKFFKRIKS

SEQ ID NO: 298 - protein, 403 aa, Artificial Sequence
  Synthetic polypeptide
SSVLNMRYKNDKYVDTSGYDSNININGDVYKYPTNKNQFEIYNDKLSEVNISQNDYIIYDNKYKNFSISFWVRIPNYDNKIVNVNNEYTIINCMRDNNSGWKVSLNHNEIIWTLQDNAGINQKLAFNYGNANGISDYINKWIFVTITNDRLGDSKLYINGNLIDQKSILNLGNIHVSDNILFKIVNCSYTRYIGIRYFNIFDKELDETEIQTLYSNEPNTNILKDFWGNYLLYDKEYYLLNVLKPNNFIDRRKDSTLSINNIRSTILLANRLYSGIKVKIQRVNNSSTNDNLVRKNDQVYINFVASKTHLFPLYADTATTNKEKTIKISSSGNRFNQVVVMNSVGNNCTMNFKNNNGNNIGLLGFKADTVVASTWYYTHMRDHTNSNGCFWNFISEEHGWQEK

SEQ ID NO: 299 - protein, 403 aa, Artificial Sequence; identical to SEQ ID NO: 298
  Synthetic polypeptide

SEQ ID NO: 300 - protein, 438 aa, Artificial Sequence; identical to SEQ ID NO: 297
  Synthetic polypeptide

SEQ ID NO: 301 - protein, 206 aa, Artificial Sequence; identical to SEQ ID NO: 292
  Synthetic polypeptide

SEQ ID NO: 302 - protein, 116 aa, Artificial Sequence; identical to SEQ ID NO: 290
  Synthetic polypeptide

SEQ ID NO: 303 - protein, 429 aa, Artificial Sequence
  Synthetic polypeptide
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLL

SEQ ID NO: 304 - protein, 436 aa, Artificial Sequence
  Synthetic polypeptide
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQM

SEQ ID NO: 305 - protein, 436 aa, Artificial Sequence
  Synthetic polypeptide
MPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKF

SEQ ID NO: 306 - protein, 436 aa, Artificial Sequence
  Synthetic polypeptide
MTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKV

SEQ ID NO: 307 - protein, 436 aa, Artificial Sequence; identical to SEQ ID NO: 306
  Synthetic polypeptide

SEQ ID NO: 308 - protein, 428 aa, Artificial Sequence; identical to SEQ ID NO: 208
  Synthetic polypeptide

SEQ ID NO: 309 - protein, 449 aa, Artificial Sequence
  Synthetic polypeptide
MPVNIKNFNYNDPINNDDIIMMEPFNDPGPGTYYKAFRIIDRIWIVPERFTYGFQPDQFNASTGVFSKDVYEYYDPTYLKTDAEKDKFLKTMIKLFNRINSKPSGQRLLDMIVDAIPYLGNASTPPDKFAANVANVSINKKIIQPGAEDQIKGLMTNLIIFGPGPVLSDNFTDSMIMNGHSPISEGFGARMMIRFCPSCLNVFNNVQENKDTSIFSRRAYFADPALTLMHELIHVLHGLYGIKISNLPITPNTKEFFMQHSDPVQAEELYTFGGHDPSVISPSTDMNIYNKALQNFQDIANRLNIVSSAQGSGIDISLYKQIYKNKYDFVEDPNGKYSVDKDKFDKLYKALMFGFTETNLAGEYGIKTRYSYFSEYLPPIKTEKLLDNTIYTQNEGFNIASKNLKTEFNGQNKAVNKEAYEEISLEHLVIYRIAMCKPVMYKNAPPTPG

SEQ ID NO: 310 - protein, 20 aa, Artificial Sequence
  Synthetic polypeptide
MGNEIDTQNRQIDRIMEKAD

SEQ ID NO: 311 - protein, 20 aa, Artificial Sequence
  Synthetic polypeptide
NGSLCDQEIDSICSIERADN

SEQ ID NO: 312 - protein, 60 aa, Artificial Sequence
  Synthetic polypeptide
TSNRRLQQTQAQVEEVVDIIRVNVDKVLERDQKLSELDDRADALQAGASQFESSAAKLKR

SEQ ID NO: 313 - protein, 78 aa, Artificial Sequence
  Synthetic polypeptide
GGSGGSGGSKGLDKVMETQAQVDELKGIMVRNIDLVAQRGERLELLIDKTENLVDSSVTFKTTSRNLARGGSGGSGGS

SEQ ID NO: 314 - protein, 179 aa, Artificial Sequence; identical to SEQ ID NO: 288
  Synthetic polypeptide

SEQ ID NO: 315 - protein, 78 aa, Artificial Sequence; identical to SEQ ID NO: 313
  Synthetic polypeptide

SEQ ID NO: 316 - protein, 403 aa, Artificial Sequence [sequence omitted]

SEQ ID NO: 317 - protein, 20 aa, Artificial Sequence
  Synthetic polypeptide
NGSLCDQEIDSICSIERADN

SEQ ID NO: 318 - protein, 206 aa, Artificial Sequence; identical to SEQ ID NO: 292
  Synthetic polypeptide

SEQ ID NO: 319 - protein, 116 aa, Artificial Sequence; identical to SEQ ID NO: 290
  Synthetic polypeptide

SEQ ID NO: 320 - protein, 20 aa, Artificial Sequence
  Synthetic polypeptide
MGNEIDTQNRQIDRIMEKAD

SEQ ID NO: 321 - protein, 60 aa, Artificial Sequence; identical to SEQ ID NO: 312
  Synthetic polypeptide

SEQ ID NO: 322 - protein, 179 aa, Artificial Sequence; identical to SEQ ID NO: 288
  Synthetic polypeptide

SEQ ID NO: 323 - protein, 78 aa, Artificial Sequence; identical to SEQ ID NO: 313
  Synthetic polypeptide

SEQ ID NO: 324 - protein, 60 aa, Artificial Sequence; identical to SEQ ID NO: 312
  Synthetic polypeptide

SEQ ID NO: 325 - protein, 60 aa, Artificial Sequence
  Synthetic polypeptide
KGLDKVMETQAQVDELKGIMVRNIDLVAQRGERLELLIDKTENLVDSSVTFKTTSRNLAR

SEQ ID NO: 326 - protein, 29 aa, Artificial Sequence
  Synthetic polypeptide
GSGGGASGGAGENLYFQSAGGSAGSGAGG

SEQ ID NO: 327 - protein, 60 aa, Artificial Sequence; identical to SEQ ID NO: 312
  Synthetic polypeptide

SEQ ID NO: 328 - protein, 60 aa, Artificial Sequence
  Synthetic polypeptide
TSNRRLQQTQAQVDEVVDIMRVNVDKVLERDQKLSELDDRADALQAGASQFETSAAKLKR

SEQ ID NO: 329 - protein, 60 aa, Artificial Sequence
  Synthetic polypeptide
TSNRRLQQTQAQVEEVVDIIRVNVDKVLERGQKLSELDDRADALQAGASQFESSAAKLKR

SEQ ID NO: 330 - protein, 60 aa, Artificial Sequence
  Synthetic polypeptide
TSNRRLQQTQAQVEEVVDIIRVNVDKVAERGQKLSELDDRADALQAGASQFESSAAKLKR

SEQ ID NO: 331 - protein, 60 aa, Artificial Sequence
  Synthetic polypeptide
TSNRRLQQTQAQVEEVVDIIRVNVDKVAERGEKLSELDDRADALQAGASQFESSAAKLKR

SEQ ID NO: 332 - protein, 60 aa, Artificial Sequence
  Synthetic polypeptide
KGLDKVQQTQAQVEEVVDIIRVNVDKVAERGEKLSELDDRTENLVDSSVTFKTTSRNLAR

SEQ ID NO: 333 - protein, 60 aa, Artificial Sequence; identical to SEQ ID NO: 332
  Synthetic polypeptide

SEQ ID NO: 334 - protein, 60 aa, Artificial Sequence; identical to SEQ ID NO: 325
  Synthetic polypeptide

SEQ ID NO: 335 - protein, 60 aa, Artificial Sequence; identical to SEQ ID NO: 312
  Synthetic polypeptide

SEQ ID NO: 336 - protein, 60 aa, Artificial Sequence; identical to SEQ ID NO: 328
  Synthetic polypeptide

SEQ ID NO: 337 - protein, 60 aa, Artificial Sequence
  Synthetic polypeptide
GSNRRLQQTQNQVDEVVDIMRVNVDKVLERDQKLSELDDRADALQAGASQFETSAAKLKR

SEQ ID NO: 338 - protein, 52 aa, Artificial Sequence
  Synthetic polypeptide
  misc_feature (1)..(2): Xaa can be any naturally occurring amino acid
  misc_feature (12)..(12): Xaa can be any naturally occurring amino acid
  misc_feature (15)..(16): Xaa can be any naturally occurring amino acid
  misc_feature (20)..(20): Xaa can be any naturally occurring amino acid
  misc_feature (23)..(23): Xaa can be any naturally occurring amino acid
  misc_feature (27)..(27): Xaa can be any naturally occurring amino acid
  misc_feature (30)..(30): Xaa can be any naturally occurring amino acid
  misc_feature (32)..(32): Xaa can be any naturally occurring amino acid
  misc_feature (37)..(37): Xaa can be any naturally occurring amino acid
  misc_feature (39)..(39): Xaa can be any naturally occurring amino acid
  misc_feature (41)..(41): Xaa can be any naturally occurring amino acid
  misc_feature (43)..(44): Xaa can be any naturally occurring amino acid
  misc_feature (50)..(50): Xaa can be any naturally occurring amino acid
XXTQAQVEEVKXIMXXNVDXVLXRGEXLEXLXDKTEXLXAXSXXFKTTSXKL

SEQ ID NO: 339 - protein, 52 aa, Artificial Sequence
  Synthetic polypeptide
QQTQAQVEEVVDIIRVNVDKVLERDQKLSELDDRADALQAGASQFESSAAKL

SEQ ID NO: 340 - protein, 52 aa, Artificial Sequence
  Synthetic polypeptide
METQAQVDELKGIMVRNIDLVAQRGERLELLIDKTENLVDSSVTFKTTSRNL

SEQ ID NO: 341 - protein, 52 aa, Artificial Sequence
  Synthetic polypeptide
RNLQSEVEGVKNIMIQNVERILARGENLEHLRNKTEDLEATSEHFKTTSQKV

SEQ ID NO: 342 - protein, 60 aa, Artificial Sequence; identical to SEQ ID NO: 312
  Synthetic polypeptide

SEQ ID NO: 343 - protein, 60 aa, Artificial Sequence; identical to SEQ ID NO: 325
  Synthetic polypeptide

SEQ ID NO: 344 - protein, 60 aa, Artificial Sequence
  Synthetic polypeptide
GGNDRVRNLQSEVEGVKNIMTQNVERILARGENLEHLRNKTEDLEATSEHFKTTSQKVAR

SEQ ID NO: 345 - protein, 57 aa, Artificial Sequence
  Synthetic polypeptide
RLQQTQAQVEEVVDIIRVNVDKVLERDQKLSELDDRADALQAGASQFESSAAKLKRK

SEQ ID NO: 346 - protein, 57 aa, Artificial Sequence
  Synthetic polypeptide
KVMETQAQVDELKGIMVRNIKLVAQRGERLELLIDKTENLVDSSVTFKTTSRNLARA

SEQ ID NO: 347 - protein, 59 aa, Artificial Sequence
  Synthetic polypeptide
  misc_feature (1)..(1): Xaa can be any naturally occurring amino acid
  misc_feature (8)..(8): Xaa can be any naturally occurring amino acid
  misc_feature (10)..(12): Xaa can be any naturally occurring amino acid
  misc_feature (14)..(16): Xaa can be any naturally occurring amino acid
  misc_feature (18)..(18): Xaa can be any naturally occurring amino acid
  misc_feature (20)..(20): Xaa can be any naturally occurring amino acid
  misc_feature (22)..(22): Xaa can be any naturally occurring amino acid
  misc_feature (25)..(25): Xaa can be any naturally occurring amino acid
  misc_feature (27)..(27): Xaa can be any naturally occurring amino acid
  misc_feature (29)..(30): Xaa can be any naturally occurring amino acid
  misc_feature (32)..(32): Xaa can be any naturally occurring amino acid
  misc_feature (34)..(37): Xaa can be any naturally occurring amino acid
  misc_feature (39)..(44): Xaa can be any naturally occurring amino acid
  misc_feature (46)..(51): Xaa can be any naturally occurring amino acid
  misc_feature (53)..(53): Xaa can be any naturally occurring amino acid
  misc_feature (55)..(58): Xaa can be any naturally occurring amino acid
XZTQAQVXEXXXIXXXNXDXVXZRXZXLXXLXDXXXXLXXXXXXFXXXXXXLXRXXXXK

SEQ ID NO: 348 - protein, 59 aa, Artificial Sequence
  Synthetic polypeptide
QQTQAQVEEVVDIIRVNVDKVLERDQKLSELDDRADALQAGASQFESSAAKLKRKYWWK

SEQ ID NO: 349 - protein, 59 aa, Artificial Sequence
  Synthetic polypeptide
METQAQVDELKGIMVRNIDLVAQRGERLELLIDKTENLVDSSVTFKTTSRNLARAMCMK

SEQ ID NO: 350 - protein, 57 aa, Artificial Sequence; identical to SEQ ID NO: 345
  Synthetic polypeptide

SEQ ID NO: 351 - protein, 57 aa, Artificial Sequence
  Synthetic polypeptide
KVMETQAQVDELKGIMVRNIDLVAQRGERLELLIDKTENLVDSSVTFKTTSRNLARA

SEQ ID NO: 352 - protein, 62 aa, Artificial Sequence
  Synthetic polypeptide
TSNRRLQQTQAQVDEVVDIMRVNVDKVLERDQKLSELDDRADALQAGASQFETSAAKLKRKY

SEQ ID NO: 353 - protein, 65 aa, Artificial Sequence
  Synthetic polypeptide
SENKGLDKVMETQAQVDELKGIMVRNIDLVAQRGERLELLIDKTENLVDSSVTFKTTSRNLARAM

SEQ ID NO: 354 - protein, 57 aa, Artificial Sequence
  Synthetic polypeptide
  misc_feature (1)..(3): Xaa can be any naturally occurring amino acid
  misc_feature (10)..(10): Xaa can be any naturally occurring amino acid
  misc_feature (12)..(14): Xaa can be any naturally occurring amino acid
  misc_feature (16)..(18): Xaa can be any naturally occurring amino acid
  misc_feature (20)..(20): Xaa can be any naturally occurring amino acid
  misc_feature (22)..(22): Xaa can be any naturally occurring amino acid
  misc_feature (24)..(24): Xaa can be any naturally occurring amino acid
  misc_feature (27)..(27): Xaa can be any naturally occurring amino acid
  misc_feature (29)..(29): Xaa can be any naturally occurring amino acid
  misc_feature (31)..(32): Xaa can be any naturally occurring amino acid
  misc_feature (34)..(34): Xaa can be any naturally occurring amino acid
  misc_feature (36)..(39): Xaa can be any naturally occurring amino acid
  misc_feature (41)..(46): Xaa can be any naturally occurring amino acid
  misc_feature (48)..(53): Xaa can be any naturally occurring amino acid
  misc_feature (55)..(55): Xaa can be any naturally occurring amino acid
  misc_feature (57)..(57): Xaa can be any naturally occurring amino acid
XXXZTQAQVXEXXXIXXXNXDXVXZRXZXLXXLXDXXXXLXXXXXXFXXXXXXLXRX

SEQ ID NO: 355 - protein, 61 aa, Artificial Sequence
  Synthetic polypeptide
TSNRRLQQTQAQVEEVVDIIRVNVDKVLERDQKLSELDDRADALQAGASQFESSAAKLKRK

SEQ ID NO: 356 - protein, 61 aa, Artificial Sequence
  Synthetic polypeptide
GGNDRVRNLQSEVEGVKNIMTQNVERILARGENLEHLRNKTEDLEATSEHFKTTSQKVARK

SEQ ID NO: 357 - protein, 24 aa, Artificial Sequence
  Synthetic polypeptide
GIIGNLRHMALDMGNEIDTQNRQI

SEQ ID NO: 358 - protein, 19 aa, Artificial Sequence
  Synthetic polypeptide
CAMAAAGAEADAEAEAALN

SEQ ID NO: 359 - protein, 19 aa, Artificial Sequence
  Synthetic polypeptide
CAMAFAGKDAEAAAEAALN

SEQ ID NO: 360 - protein, 24 aa, Artificial Sequence
  Synthetic polypeptide
DRIMEKADSNKTRIDEANQRATKM

SEQ ID NO: 361 - protein, 16 aa, Artificial Sequence
  Synthetic polypeptide
AAANVVCNASSDAARN

SEQ ID NO: 362 - protein, 22 aa, Artificial Sequence
  Synthetic polypeptide
AAANVVCKNSGNASSDAAHRNA

SEQ ID NO: 363 - protein, 20 aa, Artificial Sequence
  Synthetic polypeptide
MGNEIDTQNRQIDRIMEKAD

SEQ ID NO: 364 - protein, 20 aa, Artificial Sequence
  Synthetic polypeptide
MGNEIDTQNRQICRIMEKAD

SEQ ID NO: 365 - protein, 20 aa, Artificial Sequence
  Synthetic polypeptide
MGNEIDTQNRQICSIMEKAD

SEQ ID NO: 366 - protein, 20 aa, Artificial Sequence
  Synthetic polypeptide
MGSLCDTQNRQICSIMEKAD

SEQ ID NO: 367 - protein, 20 aa, Artificial Sequence
  Synthetic polypeptide
NGSLCDQEIDSICSIMEKAD

SEQ ID NO: 368 - protein, 20 aa, Artificial Sequence
  Synthetic polypeptide
NGSLCDQEIDSICSIERADN

SEQ ID NO: 369 - protein, 20 aa, Artificial Sequence
  Synthetic polypeptide
MGNEIDTQNRQIDRIMEKAD

SEQ ID NO: 370 - protein, 20 aa, Artificial Sequence
  Synthetic polypeptide
MGNEIDTQNRQIDSIMEKAD

SEQ ID NO: 371 - protein, 20 aa, Artificial Sequence
  Synthetic polypeptide
MGNEIDTQNRQICSIMEKAD

SEQ ID NO: 372 - protein, 20 aa, Artificial Sequence
  Synthetic polypeptide
MGSLCDTQNRQICSIMEKAD

SEQ ID NO: 373 - protein, 20 aa, Artificial Sequence
  Synthetic polypeptide
NGSLCDQEIDSICSIMEKAD

SEQ ID NO: 374 - protein, 20 aa, Artificial Sequence
  Synthetic polypeptide
NGSLCDQEIDSICSIERADN

SEQ ID NO: 375 - protein, 20 aa, Artificial Sequence
  Synthetic polypeptide
MGNEIDTQNRQIDRIMEKAD

SEQ ID NO: 376 - protein, 20 aa, Artificial Sequence
  Synthetic polypeptide
MGNEIDTQNRQICRIMEKAD

SEQ ID NO: 377 - protein, 20 aa, Artificial Sequence
  Synthetic polypeptide
MGNEIDTQNRQICSIMEKAD

SEQ ID NO: 378 - protein, 20 aa, Artificial Sequence
  Synthetic polypeptide
MGSLCDTQNRQICSIMEKAD

SEQ ID NO: 379 - protein, 20 aa, Artificial Sequence
  Synthetic polypeptide
NGSLCDQEIDSICSIMEKAD

SEQ ID NO: 380 - protein, 20 aa, Artificial Sequence
  Synthetic polypeptide
NGSLCDQEIDSICSIERADN

SEQ ID NO: 381 - protein, 20 aa, Artificial Sequence
  Synthetic polypeptide
MGNEIDTQNRQIDRIMEKAD

SEQ ID NO: 382 - protein, 20 aa, Artificial Sequence
  Synthetic polypeptide
MGNEIDTQNRQIDSIMEKAD

SEQ ID NO: 383 - protein, 20 aa, Artificial Sequence
  Synthetic polypeptide
MGNEIDTQNRQICSIMEKAD

SEQ ID NO: 384 - protein, 20 aa, Artificial Sequence
  Synthetic polypeptide
MGSLCDTQNRQICSIMEKAD

SEQ ID NO: 385 - protein, 20 aa, Artificial Sequence
  Synthetic polypeptide
NGSLCDQEIDSICSIMEKAD

SEQ ID NO: 386 - protein, 20 aa, Artificial Sequence
  Synthetic polypeptide
NGSLCDQEIDSICSIERADN

SEQ ID NO: 387 - protein, 20 aa, Artificial Sequence
  Synthetic polypeptide
MGNEIDTQNRQIDRIMEKAD

SEQ ID NO: 388 - protein, 20 aa, Artificial Sequence
  Synthetic polypeptide
IGNEIDAQNPQIKRITDKAD

SEQ ID NO: 389 - protein, 20 aa, Artificial Sequence
  Synthetic polypeptide
NGSLCDQEIDSICSIERADN

SEQ ID NO: 390 - protein, 425 aa, Artificial sequence
  Synthetic polypeptide
MPVVINSFNYNDPVNDDTILYMQIPYEEKSKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSIILNLLVLGAGPDIFENYIYPVRKLMDSGGVYDPSNDGFGSINIVTFSPEYGYTFNDISGGYNSSTESFIADPAIILAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGHLAVNNRGQNIKLNLKIIDSIPDKAWLRKS

SEQ ID NO: 391 - protein, 425 aa, Artificial Sequence; identical to SEQ ID NO: 390
  Synthetic polypeptide

SEQ ID NO: 392 - protein, 425 aa, Artificial Sequence
  Artificial polypeptide
MPVVINSFNYNDPVNDDTILYMQIPYEEESKKYYKAFEIMRNVWIIPERNTIGTDPSDFDPPASLENGSSAYYDPNYLTTDAEKDRYLKTTIKLFKRINSNPAGEALLQEISYAKPYLGNEHTPINEFHPVTRTTSVNIKSSTNVKSSITLNLLVLGAGPDIFENYIYPVRKLTDSGGVYDPSNDGFGSINIVTFSPEYGYTFNDISGGYNSSTESFIADPAIILAHELIHALHGLYGALGVTYKETIKVKQAPLMIAEKPIRLEEFLTFGGQDLNIITSAMKEKIYNNLLANYEKIATRLSCVNSAPPEYDINEYKDYFQWKYGLDKNADGSYTVNENKFNEIYKKLYGFTEIDLANKLKVKCRNTYFIKHGFLKVPNLLDDDIYTVSEGFNIGHLAVNNRGQNIKLNLKIIDSIPDKAWLRKS

SEQ ID NO: 393 - protein, 425 aa, Artificial Sequence
  Synthetic polypeptide
MPVVINSFNYNDPVNDDTILYMQIPYEEKSKKYYKAFEIMRNVWIIPERNTIGTDPSDFDPPASLENGSSAHYDPNYLTTDAEKDRYLKTTIKLFKRINSNPAGEALLQEISYAKPYLGNEHTPINEFHPGTRTTSVNIKTSTNVKSSIILNLLVLGAGPDIFENYIYPVRKLTDSGGVYDPSNDGFGSINIVTFSPEYGYTFNDISGGYNSSTESFIADPAIILAHELIHALHGLYGALGVTYKETIKVKQAPLMIAEKPIRLEEFLTFGGQDLNIITSAMKEKIYNNLLANYEKIATRLSRVNSAPPEYDINEYKDYFQWKYGLDKNADGSYTVNENKFNEIYKKLYGFTEIDLANKLKVKCRNTYFIKHGFLKVPNLLDDDIYTVSEGFNIGHLAVNNRGQNIKLNLKIIDSIPDKAWLRKS

SEQ ID NO: 394 - protein, 57 aa, Artificial Sequence; identical to SEQ ID NO: 345
  Synthetic polypeptide

SEQ ID NO: 395 - protein, 57 aa, Artificial Sequence; identical to SEQ ID NO: 351
  Synthetic polypeptide

SEQ ID NO: 396 - protein, 57 aa, Artificial Sequence; identical to SEQ ID NO: 345
  Synthetic polypeptide

SEQ ID NO: 397 - protein, 57 aa, Artificial Sequence; identical to SEQ ID NO: 351
  Synthetic polypeptide

SEQ ID NO: 398 - protein, 35 aa, Artificial Sequence
  Synthetic polypeptide
TQAQVDEVVDIMRVNVDKVLERDQKLSELDDRADA

SEQ ID NO: 399 - protein, 35 aa, Artificial Sequence
  Synthetic polypeptide
TQAQVDELKGIMVRNIDLVAQRGERLELLIDKTEN

SEQ ID NO: 400 - protein, 35 aa, Artificial Sequence; identical to SEQ ID NO: 398
  Synthetic polypeptide

SEQ ID NO: 401 - protein, 35 aa, Artificial Sequence
  Synthetic polypeptide
IMVRNIDLVAQRGERLELLIDKTENLVDSSVTFKT

What is claimed is:

1. A method for evolving a Botulinum neurotoxin (BoNT) protease, the method comprising:
  (a) contacting a population of host cells with a population of phage vectors comprising a gene encoding a BoNT B, BoNT D, BONT E, or BoNT F protease and being deficient in at least one gene for the generation of infectious phage particles, wherein;
    (1) the host cells are amenable to transfer of the vector;
    (2) the vector allows for expression of the BoNT protease in the host cell and can be replicated by the host cell, and the replicated vector can transfer into a second host cell; and
    (3) the host cell expresses a gene product encoded by the at least one gene for the generation of infectious phage particles of (a) in response to the activity of the BoNT protease, and the level of gene product expression depends on the activity of the BoNT protease;
  (b) incubating the population of host cells under conditions allowing for mutation of the gene encoding the BoNT protease and the transfer of the vector comprising the gene encoding the BONT protease from host cell to host cell, wherein host cells are removed from the host cell population, and the population of host cells is replenished with fresh host cells that do not harbor the vector; and
  (c) isolating a replicated vector from the host cell population in (b), wherein the replicated vector comprises a mutated version of the gene encoding an evolved BONT B, BoNT D, BONT E, or BoNT F protease,
  wherein the host cell expresses a fusion protein comprising:
    (i) a transcriptional activator; and
    (ii) an inhibitor of the transcriptional activator, wherein the inhibitor is fused to the transcriptional activator via a linker comprising a BoNT protease cleavage site that is cleaved by the evolved BONT protease; and
  wherein the BoNT protease cleavage site comprises the sequence: NGSLCDQEIDSICSIERADN (SEQ ID NO: 311) or GGSGGSGG-SKGLDKVMETQAQVDELKGIMVRNIDLVAQRG-ERLELLIDKTENLVDSSVTF KTTSRN-LARGGSGGSGGS (SEQ ID NO: 313).

2. The method of claim 1, wherein the at least one gene for the generation of infectious phage particles is expressed under the control of a promoter activated by the transcriptional activator of (i).

3. The method of claim 1, wherein the transcriptional activator is an RNA polymerase.

4. The method of claim 3, wherein the RNA polymerase is a T7 RNA polymerase.

5. The method of claim 1, wherein the inhibitor of the transcriptional activator is T7 lysozyme.

6. The method of claim 1, wherein the phage vectors are filamentous phage vectors.

7. The method of claim 6, wherein the phage vectors are M13 phage vectors.

8. The method of claim 1, wherein the host cells are bacterial host cells.

9. The method of claim 8, wherein the bacterial host cells are *E. coli* cells.

10. The method of claim 9, wherein the *E. coli* cells are *E. coli* cells of the genotype F'proA+B+Δ(lacIZY) zzf:: Tn10(TetR)/endA1 recA1 galE15 galK16 nupG rpsL ΔlacIZYA araD139 Δ(ara,leu)7697 mcrA Δ(mrr-hsdRMS-mcrBC) proBA:: pir1 16 λ—.

11. The method of claim 1, wherein the host cells further comprise an accessory plasmid encoding the at least one gene for the generation of infectious phage particles.

12. The method of claim 11, wherein the host cells further comprise a helper plasmid.

13. The method of claim 12, wherein together, the helper plasmid and the accessory plasmid comprise all genes required for the generation of an infectious phage.

14. The method of claim 1, wherein the host cells further comprise a mutagenesis plasmid.

15. The method of claim 1, wherein the at least one gene for the generation of infectious phage particles comprises a sequence encoding a pIII protein.

16. The method of claim 1, wherein the host cells further comprise an expression construct encoding a dominant-negative form of the at least one gene for the generation of infectious phage particles.

17. The method of claim 16, wherein the dominant-negative form of the at least one gene for the generation of infectious phage particles is driven by a promoter, the activity of which depends on an undesired function of the BoNT protease.

18. The method of claim 16, wherein the dominant-negative form of the at least one gene for the generation of infectious phage particles is a dominant-negative form of a pIII protein.

19. The method of claim 16, wherein the dominant-negative form is pIII-neg protein.

20. The method of claim 1, wherein the method comprises performing steps (a)-(c) at least two times.

* * * * *